(12) United States Patent
Philip

(10) Patent No.: US 9,132,178 B2
(45) Date of Patent: Sep. 15, 2015

(54) CYTOTOXIC T LYMPHOCYTE INDUCING IMMUNOGENS FOR PREVENTION TREATMENT AND DIAGNOSIS OF CANCER

(75) Inventor: Ramila Philip, Ivyland, PA (US)

(73) Assignee: Immunotope, Inc., Doylestown, PA (US)

(*) Notice: Subject to any disclaimer, the term of this patent is extended or adjusted under 35 U.S.C. 154(b) by 0 days.

(21) Appl. No.: 13/387,817

(22) PCT Filed: Jun. 13, 2010

(86) PCT No.: PCT/US2010/038442
§ 371 (c)(1),
(2), (4) Date: Jan. 30, 2012

(87) PCT Pub. No.: WO2011/025572
PCT Pub. Date: Mar. 3, 2011

(65) Prior Publication Data
US 2012/0141579 A1 Jun. 7, 2012

Related U.S. Application Data

(60) Provisional application No. 61/236,969, filed on Aug. 26, 2009.

(51) Int. Cl.
*A61K 39/00* (2006.01)
*C07K 14/47* (2006.01)
*G01N 33/574* (2006.01)

(52) U.S. Cl.
CPC ......... *A61K 39/0011* (2013.01); *C07K 14/4748* (2013.01); *G01N 33/57423* (2013.01); *A61K 39/00* (2013.01)

(58) Field of Classification Search
CPC .............. C07K 14/4748; G01N 33/57423; A61K 39/00
See application file for complete search history.

(56) References Cited

U.S. PATENT DOCUMENTS

| | | | |
|---|---|---|---|
| 4,235,871 A | 11/1980 | Papahadjopoulos et al. | |
| 4,501,728 A | 2/1985 | Geho et al. | |
| 4,690,915 A | 9/1987 | Rosenberg et al. | |
| 4,722,848 A | 2/1988 | Paoletti et al. | |
| 4,837,028 A | 6/1989 | Allen | |
| 4,844,893 A | 7/1989 | Hosnik et al. | |
| 5,019,369 A | 5/1991 | Presant | |
| 5,635,363 A | 6/1997 | Altman et al. | |
| 2008/0107668 A1* | 5/2008 | Philip et al. | 424/185.1 |

FOREIGN PATENT DOCUMENTS

| WO | WO 03047526 A2 * | 6/2003 |
|---|---|---|
| WO | WO 03080795 A2 * | 10/2003 |

OTHER PUBLICATIONS

Slovin SF, Lackman RD, Ferrone S, Kiely PE, Mastraugelo MJ. Cellular immune response to human sarcomas: cytotoxic T cell clones reactive with autologous sarcomas. I. Development, phenotype, and specificity, J Immunol. 1986;137(9):3042-8. Epub Nov. 1, 1986. PubMed PMID: 3093588

Schendel DJ, Gansbacher B, Oberneder R, Knegmair M, Hofstetter A, Riethmuller G, et al. Tumor-specific lysis of human renal cell carcinomas by tumor-infiltrating lymphocytes. I. HLA-A2-restricted recognition of autologous and allogeneic tumor lines. J Immunol. 1993;151(8):4209-20. Epub Oct. 15, 1993. PubMed PMID: 8409397.

Jacob L, Somasundaram R, Smith W, Monos D, Basak S, Marincola F, et al. Cytotoxic T-cell clone against rectal carcinoma induced by stimulation of a patient's peripheral blood mononuclear cells with autologous cultured tumor cells. Int J Cancer. 1997;71(3):325-32. Epub May 2, 1997. PubMed PMID: 93139862.

Ioannides CG, Freedman RS, Platsoucas CD, Rashed S, Kim YP. Cytotoxic T cell clones isolated from ovarian tumor-infiltrating lymphocytes recognize multiple antigenic epitopes on autologous tumor cells. J Immunol. 1991;146(5):1700-7. Epub Mar. 1, 1991. PubMed PMID: 1704404.

Peoples GE, Schoof DD, Andrews JV, Goedegebuure PS, Eberlein TJ. T-cell recognition of ovarian cancer. Surgery. 1993;114(2):227-34. Epub Aug. 1, 1993. PubMed PMID: 8342128.

Peiper M, Goedegebuure PS, Linehan DC, Ganguly E, Douville CC, Eberlein TJ. The HER2/neu-derived peptide p654-662 is a tumor-associated antigen in human pancreatic cancer recognized by cytotoxic T lymphocytes. Eur J Immunol. 1997;27(5):1115-23. Epub May 1, 1997. doi: 10.1002/eji 1830270511. PubMed PMID: 9174600.

Wolfel T, Herr W, Coulie P, Schmitt U, Meyer Zum Buschenfelde KH, Knuth A. Lysis of human pancreatic adenocarcinoma cells by autologous HLA-class I-restricted cytolytic T-lymphocyte (CTL) clones. Int J Cancer 1993;54(4):636-44. Epub Jun. 19, 1993. PubMed PMID: 8514455.

Yasumura S, Hirabayashi H, Schwartz DR, Toso JF, Johnson JT, Herberman RB, et al. Human cytotoxic T-cell lines with restricted specificity for squamous cell carcinoma of the head and neck. Cancer Res. 1993:53(6):1461-8. Epub Mar. 15, 1993. PubMed PMID: 8443824.

Slinglluff CL, Jr., Cox AL, Stover JM, Jr., Moore MM, Hunt DF, Engelhard VH. Cytotoxic T-lymphocyte response to autologous human squamous cell cancer of the lung: epitope reconstitution with peptides extracted from HLA-Aw68. Cancer Res. 1994;54(10):2731-7. Epub May 15, 1994. PubMed PMID: 7513255.

Yoshino I, Goedegebuure PS, Peoples GE, Parikh AS, DiMaio JM, Lyerly EK, et al. HER2/neu-derived peptides are shared antigens among human non-small cell lung cancer and ovarian cancer. Cancer Res. 1994;54(13):3387-90. Epub Jul. 1, 1994. PubMed PMID: 7912166.

Boon T, Cerottini JC, Van Den Eynde B, Van Der Bruggen P, Vanpela. Tumor antigens recognized by T lymphocytes. Annu Rev Immunol. 1994;12:337-65. Epub Jan. 1, 1994. doi: 10.1146/annurev.iy.12.040194.002005. PubMed PMID: 8011285.

Rosenberg SA, Packard BS, Aebersold PM, Solomon D, Topalian SL, Toy ST, et al. Use of tumor-infiltrating lymphocytes and interleukin-2 in the immunotherapy of patients with metastatic melanoma. A preliminary report, N Engl J Med. 1988,319(25):1676-80. Epub Dec. 22, 1988. doi: 10.1056/NEJM198812223192527. PubMed MID: 3264384.

(Continued)

*Primary Examiner* — Cherie M Stanfield
(74) *Attorney, Agent, or Firm* — Joseph F. Aceto, Esq.

(57) ABSTRACT

The present invention relates to compositions and methods for the prevention, treatment, and diagnosis of cancer, especially carcinomas, such as lung carcinoma. The invention discloses peptides, polypeptides, and polynucleotides that can be used to stimulate a CTL response against lung and other cancers.

12 Claims, 3 Drawing Sheets

(56) References Cited

OTHER PUBLICATIONS

Celluzzi CM, Mayordomo JI, Storkus WJ, Lotze MT, Falo LD, Jr. Peptide-pulsed dendritic cells induce antigen-specific CTL-mediated protective tumor immunity, J Exp Med. 1996,183(1):283-7 Epub Jan. 1, 1996. PubMed PMID: PMC2192396.

Mayordomo JI, Zorina T, Storkus WJ, Zitvogel L, Celluzzi C, Falo LD, et al. Bone marrow-derived dendritic cells pulsed with synthetic tumour peptides elicit protective and therapeutic antitumour immunity. Nat Med. 1995;1(12):1297-302. Epub Dec. 1, 1995. PubMed PMID: 7489412.

Zitvogel L, Mayordomo JI, Tjandrawan T, DeLeo AB, Clarke MR, Lotze MT, et al. Therapy of murine tumors with tumor peptide-pulsed dendritic cells: dependence on T cells, B7 costimulation, and T helper cell 1-associated cytokines. J Exp Med. 1996;183(1):87-97. Epub Jan. 1, 1996. PubMed PMID: 8551248; PubMed Central PMCID: PMC2192415.

Rock KL, Goldberg AL. Degradation of cell proteins and the generation of MHC class I-presented peptides. Annu Rev Immunol. 1999;17:739-79. Epub Jun. 8, 1999. doi: 10.1146/annurev.immunol.17.1.739. PubMed PMID: 10358773.

Watts C. Capture and processing of exogenous antigens for presentation on MHC molecules. Annu Rev Immunol. 1997;15:821-50. Epub Jan. 1, 1997. doi: 10.1146/annurev.immunol.15.1.821 PubMed PMID: 9143708.

Rosenberg SA. A new era for cancer immunotherapy based on the genes that encode cancer antigens. Immunity. 1999;10(3)281-7. Epub Apr. 16, 1999. PubMed PMID: 10204484.

Gilboa E. The makings of a tumor rejection antigen. Immunity. 1999,11(3):263-70. Epub Oct. 8, 1999. PubMed PMID: 10514004.

Yewdell JW, Bennink JR. Mechanisms of viral interference with MHC class I antigen processing and presentation. Annual review of cell and developmental biology, 1999;15:579-606. Epub Dec. 28, 1999. doi: 10.1146/annurev.cellbio.15.1.579. PubMed PMID: 10611973.

Henderson RA, Cox AL, Sakaguchi K, Appella E, Shabanowitz J, Hunt DF, et al. Direct identification of an endogenous peptide recognized by multiple HLA-A2.1-specific cytotoxic T cells. Proc Nati Aad Sci U S A. 1993;90 (21):10275-9. Epub Nov. 1, 1993. PubMed PMID: 7694236; PubMed Central PMCID: PMC47757.

Hogan KT, Eisinger DP, Cupp SB, 3rd, Lekstrom KJ, Deacon DD, Shabanowitz J, et al. The peptide recognized by HLA-A68.2-restricted, squamous cell carcinoma of the lung-specific cytotoxic T lymphocytes is derived from a mutated elongation factor 2 gene. Cancer Res. 1998;58(22):5144-50. Epub Nov. 21, 1998. PubMed PMID: 9823325.

Hunt DF, Henderson RA, Shabanowitz J, Sakaguchi K, Michel H, Sevilir N, et al. Characterization of peptides bound to the class I MHC molecule HLA-A2.1 by mass spectrometry Science. 1992;255(5049).1261-3. Epub Mar. 6, 1992. PubMed PMID: 1546328.

Slingluff CL, Jr., Cox AL, Henderson RA, Hunt DF, Engelhard VH. Recognition of human melanoma cells by HLA-A2.1-restricted cytotoxic T lymphocytes is mediated by at least six shared peptide epitopes. J Immunol. 1993;150(7):2955-63. Epub Apr. 1, 1993. PubMed PMID: 7681084.

Posnett DN, McGrath H, Tam JP. A novel method for producing anti-peptide antibodies. Production of site-specific antibodies to the T cell antigen receptor beta-chain. J Biol Chem. 1988;263(4):1719-25. Epub Feb. 5, 1988. PubMed PMID: 3276675.

Parkhurst MR, Salgaller ML, Southwood S, Robbins PF, Setto A, Rosenberg SA, et al. Improved induction of melanoma-reactive CTL with peptides from the melanoma antigen gp100 modified at HLA-A 0201-binding residues. J Immunol. 1996;157(6):2539-48. Epub Sep. 15, 1996. PubMed PMID: 8805655.

Rosenberg SA, Yang JC, Schwartzentruber DJ, Hwu P, Marincola FM, Topalian SL, et al. Immunological and therapeutic evaluation of a synthetic peptide vaccine for the treatment of patients with metastatic melanoma. Nat Med. 1998;4(3):321-7. Epub Mar. 21, 1998. PubMed PMID: 9500606; PubMed Central PMCID: PMC2064864.

Gluzman Y. SV40-transformed simian cells support the replication of early SV40 mutants. Cell. 1981;23(1):175-82. Epub Jan. 1, 1981. PubMed PMID: 6260373.

Ljunggren HG, Stam NJ, Ohlen C, Neefjes JJ, Hoglund P, Heemels MT, et al. Empty MHC class I molecules come out in the cold. Nature. 1990;346(6283):476-80. Epub Aug. 2, 1990. doi: 10.1038/346476a0. PubMed PMID: 2198471.

Zeh HJ, 3rd, Leder GH, Lotze MT, Salter RD, Tector M, Stuber G, et al. Flow-cytometeric determination of peptide-class I complex formation. Identification of p53 peptides that bind to HLA-A2. Hum Immunol. 1994;39(2):76-86. Epub Feb. 1, 1994. PubMed PMID: 8175386.

Riddell SR, Greenberg PD. The use of anti-CD3 and anti-CD28 monoclonal antibodies to clone and expand human antigen-specific T cells. J Immunol Methods. 1990;128(2):189-201. Epub Apr. 17, 1990. PubMed PMID: 1691237.

Water EA, Greenberg PD, Gilbert MJ, Finch RJ, Watanabe KS, Thomas ED, et al. Reconstitution of cellular immunity against cytomegalovirus in recipients of allogeneic bone marrow by transfer of T-cell clones from the donor. N Engl J Med. 1995;333(16):1038-44. Epub Oct. 19, 1995. doi: 10.1056/NEJM199510193331306. PubMed PMID: 7675046.

Harding CV, 3rd. Electroporation of exogenous antigen into the cytosol for antigen processing and class I major histocompatibility complex (MHC) presentation: weak base amines and hypothermia (18 degrees C) inhibit the class I MHC processing pathway. Eur J Immunol. 1992;22(7):1865-9. Epub Jul. 1, 1992. doi: 10.1002/eji.1830220728. PubMed PMID: 1623927.

Reedy R, Zhou F, Huang L, Carbone F, Bevan M, Rouse BT. pH sensitive liposomes provide an efficient means of sensitizing target cells to class I restricted CTL recognition of a soluble protein. J Immunol Methods. 1991;141(2):157-63. Epub Aug. 9, 1991. PubMed PMID: 1880423.

Moore MW, Carbone FR, Bevan MJ. Introduction of soluble protein into the class I pathway of antigen processing and presentation. Cell. 1988;54(6):777-85. Epub Sep. 9, 1988. PubMed PMID: 3261634.

Tuting T, Wilson CC, Martin DM, Kasamon YL, Rowles J, Ma DI, et al. Autologous human monocyte-derived dendritic cells genetically modified to express melanoma antigens elicit primary cytotoxic T cells responses in vitro: enhancement by cotransfection of genes encoding the Th1-biasing cytokines IL-12 and IFN-alpha. J Immunol. 1998;160(3):1139-47. Epub May 7, 1998. PubMed PMID: 9570527.

Perez-Diez A, Butterfield LH, Li L, Chakraborty NG, Economu JS, Mukherji B. Generation of CD8+ and CD4+ T-cell response to dendritic cells genetically engineered to express the MART-1/Melan-A gene. Cancer Res. 1988;58(23):5305-9. Epub Dec. 16, 1998. PubMed PMID: 9850054.

North RJ, LaCourse R, Ryan L. Vaccinated mice remain more susceptible to *Mycobacterium* tuberculosis infection initiated via the respiratory route than via the intravenous route. Infect Immun. 1999;67(4):2010-2. Epub Mar. 20, 1999. PubMed PMID: 1008505; PubMed Central PMCID: PMC96560.

Riddell SR, Watanabe KS, Goodrich JM, Li CR, Agha ME, Greenberg PD. Restoration of viral immunity in immunodeficient humans by the adoptive transfer of T cell clones. Science. 1992;257(5067):238-41. Epub Jul. 10, 1992. PubMed PMID: 1352912.

Ramakrishna V, Ross MM, Pettersson M, Gatlin CC, Lyons CE, Miller CL, et al. Naturally occurring peptides associated with HLA-A2 in ovarian cancer cell lines identified by mass spectrometry are targets of HLA-A2-restricted cytotoxic T cells. Int Immunol. 2003;15(6):751-63. Epub May 17, 2003. PubMed PMID: 12750359.

Morse MA, Nair SK, Mosca PJ, Hobeika AC, Clay TM, Deng Y, et al. Immunotherapy with autologous, human dendritic cells, transfected with carcinoembryonic antigen mRNA. Cancer Invest. 2003;21(3):341-9. Epub Aug. 7, 2003. PubMed PMID: 12901279.

Hanahan D, Weinberg RA. The hallmarks of cancer. Cell. 2000;100(1):57-70. Epub Jan. 27, 2000. PubMed PMID: 10647931.

* cited by examiner

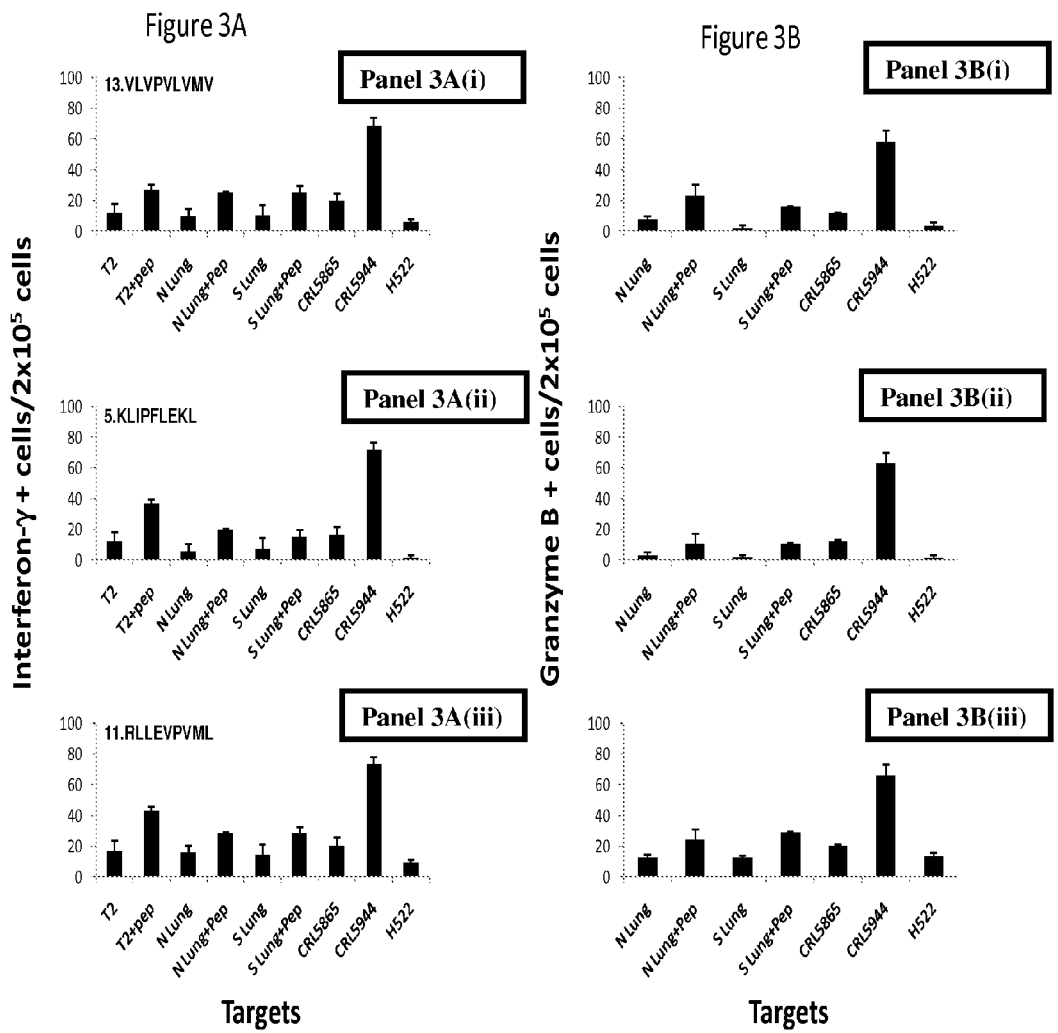

CYTOTOXIC T LYMPHOCYTE INDUCING IMMUNOGENS FOR PREVENTION TREATMENT AND DIAGNOSIS OF CANCER

CROSS REFERENCE TO RELATED APPLICATION

This application is the US national application of PCT/US10/38442, filed on Jun. 13, 2010 and which claims priority to U.S. Provisional Application No. 61/236,969, filed on Aug. 26, 2009, the disclosure of which is herein incorporated by reference.

FIELD OF THE INVENTION

The present invention relates generally to the field of immunogens whose structures incorporate polypeptides comprising epitopic peptides derived from proteins expressed by cancer cells and to uses of said immunogens in eliciting cytotoxic T lymphocyte (CTL) responses for the diagnosis, prevention and treatment of cancer, preferably carcinoma, most preferably lung carcinoma.

BACKGROUND OF THE INVENTION

The mammalian immune system has evolved a variety of mechanisms to protect the host from cancerous cells, an important component of this response being mediated by cells referred to as T cells. Cytotoxic T lymphocytes (CTLs) are specialized T cells that function primarily by recognizing and killing cancerous cells or infected cells, but also by secreting soluble molecules referred to as cytokines that can mediate a variety of effects on the immune system.

Evidence suggests that immunotherapy designed to stimulate a tumor-specific CTL response would be effective in controlling cancer. For example, it has been shown that human CTLs recognize sarcomas (Slovin, S. F. et al., J. Immunol., 137:3042-3048, (1987)), renal cell carcinomas (Schendel, D. J. et al., J. Immunol., 151:4209-4220, (1993)), colorectal carcinomas (Jacob, L. et al., Int. J. Cancer, 71:325-332, (1997)), ovarian carcinomas (Ioannides, C. G. et al., J. Immunol., 146:1700-1707, (1991)) (Peoples, G. E. et al., Surgery, 114:227-234, (1993)), pancreatic carcinomas (Peiper, M. et al., Eur. J. Immunol., 27:1115-1123, (1997); Wolfel, T. et al., Int. J. Cancer, 54:636-644, (1993)), squamous tumors of the head and neck (Yasumura, S. et al., Cancer Res., 53:1461-1468, (1993)), and squamous carcinomas of the lung (Slingluff, C. L. Jr et al., Cancer Res., 54:2731-2737, (1994); Yoshino, I. et al., Cancer Res., 54:3387-3390, (1994)). The largest number of reports of human tumor-reactive CTLs have concerned cancers (Boon, T. et al., Ann. Rev. Immunol., 12:337-365, (1994)). The ability of tumor-specific CTLs to mediate tumor regression, in both human (Rosenberg, S. A. et al., N. Engl. J. Med., 319: 1676-1680, (1988)) and animal models (Celluzzi, C. M. et al., J. Exp. Med., 183:283-287, (1996); Mayordomo, J. I. et al., Nat. Med., 1:1297-1302, (1995); Zitvogel, L. et al., J. Exp. Med., 183:87-97, (1996)), suggests that methods directed at increasing CTL activity would likely have a beneficial effect with respect to tumor treatment.

In order for CTLs to kill or secrete cytokines in response to a cancer cell, the CTL must first recognize that cell as being cancerous. This process involves the interaction of the T cell receptor, located on the surface of the CTL, with what is generically referred to as an MHC-peptide complex which is located on the surface of the cancerous cell. MHC (Major Histocompatibility Complex)-encoded molecules have been subdivided into two types, and are referred to as class I and class II MHC-encoded molecules.

In the human immune system, MHC molecules are referred to as human 30 leukocyte antigens (HLA). Within the MHC, located on chromosome six, are three different genetic loci that encode for class I MHC molecules. MHC molecules encoded at these loci are referred to as HLA-A, HLA-B, and HLA-C. The genes that can be encoded at each of these loci are extremely polymorphic, and thus, different individuals within the population express different class I MHC molecules on the surface of their cells. HLA-A1, HLA-A2, HLA-A3, HLA-B7, and HLA-B8 are examples of different class I MHC molecules that can be expressed from these loci. The present disclosure involves peptides that are associated with the HLA-A1, HLAA2, or HLA-A11 molecules, HLA-A1 supertypes, HLA-A2 supertypes, and HLA-A11 supertypes. A supertype is a group of HLA molecules that present at least one shared epitope. The present disclosure involves peptides that are associated with HLA molecules, and with the genes and proteins from which these peptides are derived.

The peptides that associate with the MHC molecules can either be derived from proteins made within the cell, in which case they typically associate with class I MHC molecules (Rock, K. L. and Golde, U., Ann. Rev. Immunol., 17:739-779, (1999)) or they can be derived from proteins that are acquired from outside of the cell, in which case they typically associate with class II MHC molecules (Watts, C., Ann. Rev. Immunol., 15:821-850, (1997)). Peptides that evoke a cancer-specific CTL response most typically associate with class I MHC molecules. The peptides that associate with a class I MHC molecule are typically nine amino acids in length, but can vary from a minimum length of eight amino acids to a maximum of fourteen amino acids in length. A class I MHC molecule with its bound peptide, or a class II MHC molecule with its bound peptide, is referred to as an MHC-peptide complex.

The process by which intact proteins are degraded into peptides is referred to as antigen processing. Two major pathways of antigen processing occur within cells (Rock, K. L. and Golde, U., Ann. Rev. Immunol., 17:739-779, (1999); Watts, C., Ann. Rev. Immunol., 15:821-850, (1997)). One pathway, which is largely restricted to cells that are antigen presenting cells such as dendritic cells, macrophages, and B cells, degrades proteins that are typically phagocytosed or endocytosed into the cell. Peptides derived in this pathway typically bind to class II MHC molecules. A second pathway of antigen processing is present in essentially all cells of the body. This second pathway primarily degrades proteins that are made within the cells, and the peptides derived from this pathway primarily bind to class I MHC molecules. It is the peptides from this second pathway of antigen processing that are referred to herein. Antigen processing by this latter pathway involves polypeptide synthesis and proteolysis in the cytoplasm. The peptides produced are then transported into the endoplasmic reticulum of the cell, associate with newly synthesized class I MHC molecules, and the resulting MHC-peptide complexes are then transported to the cell surface. Peptides derived from membrane and secreted proteins may also associate with Class I MHC molecules. In some cases these peptides correspond to the signal sequence of the proteins that are cleaved from the protein by the signal peptidase. In other cases, it is thought that some fraction of the membrane and secreted proteins are transported from the endoplasmic reticulum into the cytoplasm where processing subsequently occurs.

Once bound to the class I MHC molecule and displayed on the surface of a cell, the peptides are recognized by antigen-specific receptors on CTLs. Mere expression of the class I MHC molecule itself is insufficient to trigger the CTL to kill the target cell if the antigenic peptide is not bound to the class I MHC molecule. Several methods have been developed to identify the peptides recognized by CTL, each method relying on the ability of a CTL to recognize and kill only those cells expressing the appropriate class I MHC molecule with the peptide bound to it (Rosenberg, S. A., Immunity, 10:281-287, (1999)). Such peptides can be derived from a non-self source, such as a pathogen (for example, following the infection of a cell by a bacterium or a virus) or from a self-derived protein within a cell, such as a cancerous cell. Examples of sources of self-derived proteins in cancerous cells have been reviewed (Gilboa, E., Immunity, 11:263-270, (1999); Rosenberg, S. A., Immunity, 10:281-287, (1999)) and include: (i) mutated genes; (ii) aberrantly expressed genes such as an alternative open reading frame or through an intron-exon boundary; (iii) normal genes that are selectively expressed in only the tumor and the testis; and (iv) normal differentiation genes that are expressed in the tumor and the normal cellular counterpart.

Four different methodologies have typically been used for identifying the peptides that are recognized by CTLs. These are: (i) the genetic method; (2) motif analysis; (3) SErological analysis of REcombinant cDNA expression libraries (SEREX™); and (iv) the immunological and analytical chemistry approach or the Direct Identification of Relevant Epitopes for Clinical Therapeutics (DIRECT™).

The genetic method is an approach in which progressively smaller subsets of cDNA libraries from tumor cells are transfected into cells that express the appropriate MHC molecule but not the tumor-specific epitope. The molecular clones encoding T cell epitopes are identified by their ability to reconstitute tumor specific T cell recognition of transfected cells. The exact T cell epitope is then identified by a combination of molecular subcloning and the use of synthetic peptides based on the predicted amino acid sequence. Such methods, however, are susceptible to inadvertent identification of cross-reacting peptides, and are not capable of identifying important post-translational modifications.

Motif analysis involves scanning a protein for peptides containing known class I MHC binding motifs, followed by synthesis and assay of the predicted peptides for their ability to be recognized by tumor-specific CTL. This approach requires prior knowledge of the protein from which the peptides are derived. This approach is also greatly hampered by the fact that not all of the predicted peptide epitopes are presented on the surface of a cell (Yewdell, J. W. and Bennink, J. R., Ann. Rev. Immunol., 17:51-88, (1999)), thus additional experimentation is required to determine which of the predicted epitopes is useful.

The SEREX™ approach relies on using antibodies in the serum of cancer patients to screen cDNA expression libraries for a clone that expresses a protein recognized by the antibody. This methodology presumes that an antibody response will necessarily have developed in the presence of a T cell response, and thus, the identified clone is a good candidate to encode a protein that can be recognized by T cells.

DIRECT™ involves a combination of cellular immunology and mass spectrometry. This approach involves the actual identification of endogenous CTL epitopes present on the cell surface by sequencing the naturally occurring peptides associated with class I MHC molecules. In this approach, cells are first lysed in a detergent solution, the peptides associated with the class I MHC molecules are purified, and the peptides are fractionated by high performance liquid chromatography (HPLC). Peptide sequencing is readily performed by tandem mass spectrometry (Henderson, R. A. et al., Proc. Natl. Acad. Sci. U.S.A, 90:10275-10279, (1993); Hogan, K. T. et al., Cancer Res., 58:5144-5150, (1998); Hunt, D. F. et al., Science, 255:1261-1263, (1992); Slingluff, C. L. Jr et al., J. Immunol., 150:2955-2963, (1993)).

Immunization with cancer-derived, class I MHC molecule-associated peptides, or with a parent, or original protein or precursor polypeptide that contains the peptide, or with a gene that encodes a polypeptide or protein containing the peptide, are forms of immunotherapy that can be employed in the treatment of cancer. These forms of immunotherapy require that immunogens be identified so that they can be formulated into an appropriate vaccine. Although a variety of cancer-derived antigens have been identified (Rosenberg, S. A., Immunity, 10:281-287, (1999)), not all of these are appropriate for broad-based immunotherapy because the expression of some peptides is limited to the tumor derived from a specific patient. Furthermore, the number of class I MHC molecules from which tumor-derived peptides have been discovered is largely restricted to HLA-A2. Thus, it would be useful to identify additional HLA-A2-restricted peptides. Additionally, it would be useful to identify peptides that complex with class I MHC molecules other than HLA-A2. Such peptides would be particularly useful in the treatment of cancer patients who do not express the HLA-A2 molecule for example HLA-A1/A11 antigens, HLA-A1 supertypes, HLA-A2 supertypes and HLA-A11 supertypes. Identification of and immunization with a cancer-derived parent or original protein or with a gene that encodes the parent protein is significant because the protein can be administered to patients of any HLA type, because proteins that pass through the MHC pathway are processed in vivo to the correct HLA type-specific epitopes.

It is also particularly useful to identify antigenic peptides that are derived from different parent proteins, even if the derived peptides associate with the same class I MHC molecule. Because an active immune response can result in the outgrowth of tumor cells that have lost the expression of a particular precursor protein for a given antigenic peptide, it is advantageous to stimulate an immune response against peptides derived from more than one protein, as the chances of the tumor cell losing the expression of two or more proteins is the multiple of the chances of losing each of the individual proteins.

SUMMARY OF THE INVENTION

The present invention relates to Immunogens comprising polypeptides with amino acid sequences comprising epitopic sequences selected from the sequences of SEQ ID NO: 1-86 and which immunogens facilitate a cytotoxic T lymphocyte (CTL)-mediated immune response against cancers, especially lung cancer. The present invention also relates to nucleic acid molecules that encode for the polypeptides and/or the full length proteins, their isoforms and splice variants from which the polypeptides are derived, of such immunogens, and which can also be used to facilitate an immune response against cancer.

The present invention provides compositions comprising the immunogen described herein, and polynucleotides that direct the synthesis of such polypeptides, whereby the oligopeptides and polypeptides of such immunogens are capable of inducing a CTL response against cells expressing a protein comprising an epitopic sequence of at least one of SEQ ID NO: 1-86. The cells are usually cancer cells, preferably carcinoma cells, most preferably lung carcinomas expressing such proteins.

The present invention further relates to polynucleotides comprising the gene coding for a polypeptide of the immunogens disclosed herein. The present invention also provides methods that comprise contacting a lymphocyte, especially a CTL, with an immunogen or its isoforms or splice variants of the invention under conditions that induce a CTL response against a tumor cell, and more specifically against a lung tumor cell. The methods may involve contacting the CTL with the immunogenic peptide in vivo, in which case the peptides, polypeptides, and polynucleotides of the invention are used as vaccines, and will be delivered as a pharmaceutical composition comprising a pharmaceutically acceptable carrier or delivery system and the immunogen, typically along with an adjuvant or one or more cytokines.

Alternatively, the immunogens of the present invention can be used to induce a CTL response in vitro. The generated CTL can then be introduced into a patient with cancer, more specifically breast carcinoma, ovarian carcinoma, colorectal carcinoma, lung carcinoma, or prostate carcinoma. Alternatively, the ability to generate CTL in vitro could serve as a diagnostic for cancer generally, including breast carcinoma, ovarian carcinoma, colorectal carcinoma, lung carcinoma, or prostate carcinoma.

DESCRIPTION OF DRAWINGS

FIG. 3A. Cytotoxic T cells generated from a lung cancer patient against lung cancer epitopes recognize peptide loaded targets as well as lung cancer cells: PBMC from a HLA-A2+ donor with lung cancer were in vitro stimulated with synthetic peptides corresponding to each of the three selected lung cancer epitopes (Panel 3B(i) (SEQ ID NO: 82), Panel 3B(ii) (SEQ ID NO: 34), and Panel 3B(iii) (SEQ ID NO: 67). These cells were tested in an ELISpot assay using T2 cells loaded with the corresponding synthetic peptide, normal cell suspensions obtained from HLA-A2+ healthy, non-smoker or smoker lung tissues and HLA-A2+ lung cancer cells lines [CRL-5865, CRL-5944 and NCI-H522]. Interferon-γ producing cells were quantitated using an Immunospot reader. Error bars represent SEM of experimental replicates.

FIG. 3B. Cytotoxic T cells generated from a lung cancer patient against lung cancer epitopes are cytolytic: PBMC from a HLA-A2+ lung cancer patient were in vitro stimulated with synthetic peptides corresponding to each of the three selected lung cancer epitopes (Panel 3A(i) (SEQ ID NO: 82), Panel 3A(ii) (SEQ ID NO: 34), and Panel 3A(iii) (SEQ ID NO: 67). These cells were tested in an ELISpot assay using T2 cells loaded with the corresponding synthetic peptide, normal cell suspensions obtained from HLA-A2+ healthy, non-smoker or smoker lung tissues and HLA-A2+ lung cancer cells lines [CRL-5865, CRL-5944 and NCI-H522]. Granzyme B producing cells were quantitated using an Immunospot reader. Error bars represent SEM of experimental replicates.

DETAILED DESCRIPTION OF THE INVENTION

Definitions

Figure 1:
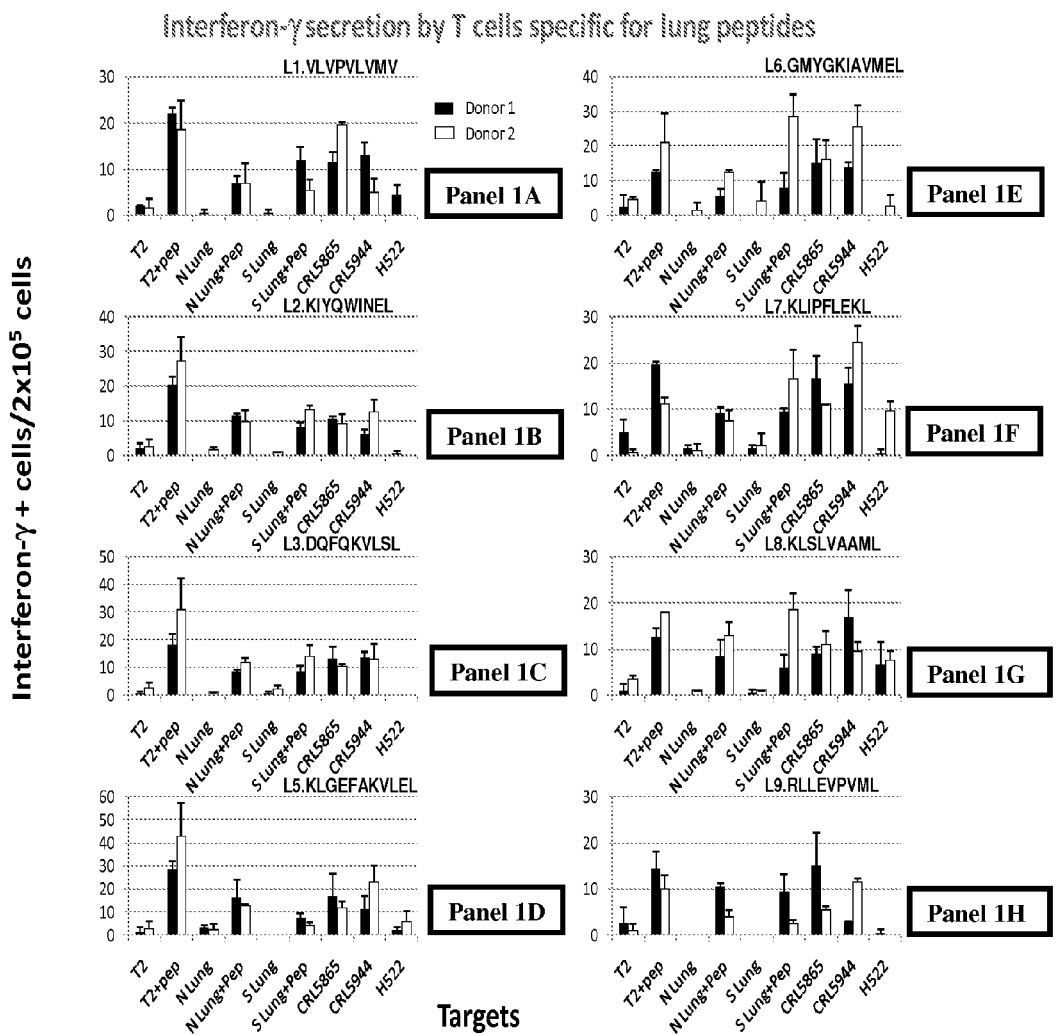
FIG. 1: Cytotoxic T cells generated against lung cancer epitopes recognize peptide loaded targets as well as lung cancer cells: PBMC from two healthy HLA-A2+ donors were in vitro stimulated with synthetic peptides corresponding to each of the eight lung cancer epitopes (Panel A VLVPVLVMV; Panel B KIYQWINEL; Panel C DQFQKVLSL; Panel D KLGEFAKVLEL; Panel E GMYGKIAVMEL; Panel F KLIPFLEKL; Panel G KSLSVAAML; Panel H RLLEVPVML). These cells were tested in an ELISpot assay using T2 cells loaded with the corresponding synthetic peptide, normal cell suspensions obtained from HLA-A2+ healthy, non-smoker or smoker lung tissues and HLA-A2+ lung cancer cells lines [CRL-5865, CRL-5944 and NCI-H522]. Interferon-γ producing cells were quantitated using an Immunospot reader. Error bars represent SEM of experimental replicates.

As used herein and except as noted otherwise, all terms are defined as given below. The term "peptide" is used herein to designate a series of amino acid residues, connected one to the other typically by peptide bonds between the alpha-amino and carbonyl groups of the adjacent amino acids. The peptides are typically 9 amino acids in length, but can be as short as 8 amino acids in length, and as long as 14 amino acids in length.

The term "oligopeptide" is used herein to designate a series of amino acid residues, connected one to the other typically by peptide bonds between the alpha-amino and carbonyl groups of the adjacent amino acids. The length of the oligopeptide is not critical to the invention as long as the correct epitope or epitopes are maintained therein. The oligopeptides are typically 30 to about 40 amino acid residues in length, and greater than about 14 amino acids in length.

The term "polypeptide" designates a series of amino acid residues, connected one to the other typically by peptide bonds between the alpha-amino and carbonyl groups of the adjacent amino acids. The length of the polypeptide is not critical to the invention as long as the correct epitopes are maintained. In contrast to the terms peptide or oligopeptide, the term polypeptide is meant to refer to protein molecules of longer than about 40 residues in length.

A peptide, oligopeptide, polypeptide, protein, or polynucleotide coding for such a molecule is "immunogenic" (and thus an "immunogen" within the present invention) if it is capable of inducing an immune response. In the case of the present invention, immunogenicity is more specifically defined as the ability to induce a CTL-mediated response. Thus, an "immunogen" would be a molecule that is capable of inducing an immune response, and in the case of the present invention, a molecule capable of inducing a CTL response. An immunogen may have one or more isoforms or splice variants that have equivalent biological and immunological activity, and are thus also considered for the purposes of this invention to be immunogenic equivalents of the original, natural polypeptide.

A T cell "epitope" is a short peptide molecule that binds to a class I or II MHC molecule and that is subsequently recognized by a T cell. T cell epitopes that bind to class I MHC molecules are typically 8-14 amino acids in length, and most typically 9 amino acids in length. T cell epitopes that bind to class II MHC molecules are typically 12-20 amino acids in length. In the case of epitopes that bind to class II MHC molecules, the same T cell epitope may share a common core segment, but differ in the length of the carboxy- and amino-terminal flanking sequences due to the fact that ends of the peptide molecule are not buried in the structure of the class II MHC molecule peptide-binding cleft as they are in the class I MHC molecule peptide-binding cleft.

Three different genetic loci encode for class I MHC molecules: HLA-A, HLA-B, and HLA-C. HLA-A1, HLA-A2, and HLA-A11 are examples of different class I MHC molecules that can be expressed from these loci. The present invention also involves peptides that are associated with HLA-A1 supertypes, HLA-A2 supertypes, and HLA-A11 supertypes. A supertype is a group of HLA molecules that present at least one shared epitope. MHC molecule peptides that have been found to bind to one member of the MHC allele supertype family (A1 for example) are thought to be likely to bind to other members of the same supertype family (HLA-A2, HLA-A24 for example).

As used herein, reference to a DNA sequence includes both single stranded and double stranded DNA. Thus, the specific sequence, unless the context indicates otherwise, refers to the single strand DNA of such sequence, the duplex of such sequence with its complement (double stranded DNA) and the complement of such sequence.

The term "coding region" refers to that portion of a gene that either naturally or normally codes for the expression product of that gene in its natural genomic environment, i.e., the region coding in vivo for the native expression product of the gene. The coding region can be from a normal, mutated or altered gene, or can even be from a DNA sequence, or gene, wholly synthesized in the laboratory using methods well known to those of skill in the art of DNA synthesis.

The term "nucleotide sequence" refers to a heteropolymer of deoxyribonucleotides. The nucleotide sequence encoding for a particular peptide, oligopeptide, or polypeptide may be naturally occurring or they may be synthetically constructed. Generally, DNA segments encoding the peptides, polypeptides, and proteins of this invention are assembled from cDNA fragments and short oligonucleotide linkers, or from a series of oligonucleotides, to provide a synthetic gene which is capable of being expressed in a recombinant transcriptional unit comprising regulatory elements derived from a microbial or viral operon.

The term "expression product" means that polypeptide or protein that is the natural translation product of the gene and any nucleic acid sequence coding equivalents resulting from genetic code degeneracy and thus coding for the same amino acid(s).

The term "fragment," when referring to a coding sequence, means a portion of DNA comprising less than the complete coding region whose expression product retains essentially the same biological or immunological function or activity as the expression product of the complete coding region.

The term "DNA segment" refers to a DNA polymer, in the form of a separate fragment or as a component of a larger DNA construct, that has been derived from DNA isolated at least once in substantially pure form, i.e., free of contaminating endogenous materials and in a quantity or concentration enabling identification, manipulation, and recovery of the segment and its component nucleotide sequences by standard biochemical methods, for example, by using a cloning vector. Such segments are provided in the form of an open reading frame uninterrupted by internal nontranslated sequences, or introns, which are typically present in eukaryotic genes. Sequences of non-translated DNA may be present downstream from the open reading frame, where the same do not interfere with manipulation or expression of the coding regions. The term "primer" means a short nucleic acid sequence that is paired with one strand of DNA and provides a free 3'OH end at which a DNA polymerase starts synthesis of a deoxyribonucleotide chain.

The term "promoter" means a region of DNA involved in binding of RNA polymerase to initiate transcription.

The term "open reading frame (ORF)" means a series of triplets coding for amino acids without any termination codons and is a sequence (potentially) translatable into protein.

The term "isolated" means that the material is removed from its original environment (e.g., the natural environment if it is naturally occurring). For example, a naturally-occurring polynucleotide or polypeptide present in a living animal is not isolated, but the same polynucleotide or polypeptide, separated from some or all of the coexisting materials in the natural system, is isolated. Such polynucleotides could be part of a vector and/or such polynucleotides or polypeptides could be part of a composition, and still be isolated in that such vector or composition is not part of its natural environment.

The polynucleotides, and recombinant or immunogenic polypeptides, disclosed in accordance with the present invention may also be in "purified" form. The term "purified" does not require absolute purity; rather, it is intended as a relative definition, and can include preparations that are highly purified or preparations that are only partially purified, as those terms are understood by those of skill in the relevant art. For example, individual clones isolated from a cDNA library have been conventionally purified to electrophoretic homogeneity. Purification of starting material or natural material to at least one order of magnitude, preferably two or three orders, and more preferably four or five orders of magnitude is expressly contemplated. Furthermore, the claimed polypeptide which has a purity of preferably 0.001%, or at least 0.01% or 0.1%; and even desirably 1% by weight or greater is expressly contemplated.

The nucleic acids and polypeptide expression products disclosed according to the present invention, as well as expression vectors containing such nucleic acids and/or such polypeptides, may be in "enriched form." As used herein, the term "enriched" means that the concentration of the material is at least about 2, 5, 10, 100, or 1000 times its natural concentration (for example), advantageously 0.01%, by weight, preferably at least about 0.1% by weight. Enriched preparations of about 0.5%, 1%, 5%, 10%, and 20% by weight are also contemplated. The sequences, constructs, vectors, clones, and other materials comprising the present invention can advantageously be in enriched or isolated form.

The term "active fragment" means a fragment that generates an immune response (i.e., has immunogenic activity) when administered, alone or optionally with a suitable adjuvant, to an animal, such as a mammal, for example, a human, and also including a rabbit or a mouse, such immune response taking the form of stimulating a CTL response within the recipient, such as a human. Alternatively, the "active fragment" may also be used to induce a CTL response in vitro.

As used herein, the terms "portion," "segment," and "fragment," when used in relation to polypeptides, refer to a continuous sequence of residues, such as amino acid residues, which sequence forms a subset of a larger sequence. For example, if a polypeptide were subjected to treatment with any of the common endopeptidases, such as trypsin or chymotrypsin, the oligopeptides resulting from such treatment would represent portions, segments or fragments of the starting polypeptide. This means that any such fragment will necessarily contain as part of its amino acid sequence a segment, fragment or portion, that is substantially identical, if not exactly identical to the naturally occurring original or "parent" proteins of the peptides of SEQ ID NO: 1-86. When used in relation to polynucleotides, such terms refer to the products produced by treatment of said polynucleotides with endonucleases.

In accordance with the present invention, the term "percent identity" or "percent identical," when referring to a sequence, means that a sequence is compared to a claimed or described sequence after alignment of the sequence to be compared (the "Compared Sequence") with the described or claimed sequence (the "Reference Sequence"). The Percent Identity is then determined according to the following formula:

Percent Identity=100[1−(C/R)]

wherein C is the number of differences between the Reference Sequence and the Compared Sequence over the length of alignment between the Reference Sequence and the Compared Sequence wherein (i) each base or amino acid in the Reference Sequence that does not have a corresponding aligned base or amino acid in the Compared Sequence and (ii) each gap in the Reference Sequence and (iii) each aligned base or amino acid in the Reference Sequence that is different from an aligned base or amino acid in the Compared Sequence, constitutes a difference; and R is the number of bases or amino acids in the Reference Sequence over the length of the alignment with the Compared Sequence with any gap created in the Reference Sequence also being counted as a base or amino acid.

If an alignment exists between the Compared Sequence and the Reference Sequence for which the percent identity as calculated above is about equal to or greater than a specified minimum Percent Identity then the Compared Sequence has the specified minimum percent identity to the Reference Sequence even though alignments may exist in which the herein above calculated Percent Identity is less than the specified Percent Identity.

The present invention relates generally to immunogens and immunogenic compositions, and methods of use thereof, for the prevention, treatment, and diagnosis of cancer, especially carcinomas, including lung carcinomas. Disclosed according to the invention are immunogens comprising proteins or polypeptides whose amino acid sequences comprises one or more epitopic oligopeptides with sequences selected from the group SEQ ID NO: 1-86. In addition, the invention further relates to polynucleotides that can be used to stimulate a CTL response against cancer, and more specifically carcinoma, especially lung carcinomas.

In accordance with the present invention there are disclosed specific oligopeptide sequences with amino acid sequences shown in SEQ ID NO: 1-86 which represent epitopic peptides (i.e. immunogenic oligopeptide sequences) of at least about 8 amino acids in length, preferably about 9 amino acids in length (i.e., nonapeptides), and no longer than about 14 amino acids in length and present as part of a larger structure, such as a polypeptide or full length protein.

While the use of specific peptides is restricted to use in patients having certain HLA types or HLA supertypes, there is no such restriction on the use of the parent protein as an immunogen. When the parent protein or immunogen is presented to the antigen processing pathway, it will be appropriately fragmented, processed and presented in the context of HLA type(s) present in the patient.

The polypeptides forming the immunogens of the present invention have amino acid sequences that comprise at least one stretch, possibly two, three, four, or more stretches of about 8 to 10 or up to 14 residues in length and which stretches differ in amino acid sequence from the sequences of SEQ ID NO: 1-86 by no more than about 1 amino acid residue, preferably a conservative amino acid residue, especially amino acids of the same general chemical character, such as where they are hydrophobic amino acids.

Said polypeptides can be of any desired length so long as they have immunogenic activity in that they are able, under a given set of desirable conditions, to elicit in vitro or in vivo the activation of cytotoxic T lymphocytes (CTLs) (i.e., a CTL response) against a presentation of a cancer specific protein, especially a carcinoma or sarcoma specific protein where said proteins are presented in vitro or in vivo by an antigen presenting cell (APC). The proteins and polypeptides forming the immunogens of the present invention can be naturally occurring or may be synthesized chemically.

The present invention is also directed to an isolated polypeptide, especially one having immunogenic activity, the sequence of which comprises within it one or more stretches comprising any 2 or more of the sequences of SEQ ID NO: 1-86 and in any relative quantities and wherein said sequences may differ by one amino acid residues from the sequences of SEQ ID NO: 1-86 in any given stretch of 8 to 10, or up to 14 amino acid residues. Thus, within the present invention, by way of a non-limiting example only, such polypeptide may contain as part of its amino acid sequence, nonapeptide fragments having up to 8 amino acids identical to a sequence of SEQ ID NO: 1, 2, 7, 8 such that the polypeptide comprises, in a specific embodiment, 2 segments with at least 8 residues identical to SEQ ID NO: 1 and SEQ ID NO: 2 and one segment with at least 8 residues identical to SEQ ID NO: 7. In other embodiments, other combinations and permutations of the epitopic sequences disclosed herein may be part of an immunogen of the present invention or of such a polypeptide so long as any such polypeptide comprises at least 2 such epitopes, whether such epitopes are different or the same. Thus, in a specific embodiment, a polypeptide of the present invention may comprise 2 copies of the sequence of SEQ ID NO: 2 at some point or points within its length. Of course, any combinations and permutations of the epitopes disclosed herein, as long as they are present at least two in number in such polypeptides, are expressly contemplated.

All of the epitopic peptides of SEQ ID NO: 1-86 are derived from proteins expressed by cancer cells and sequences and were identified through the method of Automated High Through-put Sequencing (HTPS).

Oligopeptides as disclosed herein may themselves be prepared by methods well known to those skilled in the art. (Grant, G. A., Synthetic Peptides: A User's Guide, 1992, W. H. Freeman and Company, New York; Coligan, J. E. et al, Current Protocols in Protein Science, 1999, John Wiley & Sons, Inc., New York).

Besides the sequences of SEQ ID NO:1-86, the proteins and polypeptides forming the immunogens of the present invention may also comprise one or more other immunogenic amino acid stretches known to be associated with cancer, and more specifically with carcinomas including breast carcinoma, ovarian carcinoma, colorectal carcinoma, lung carcinoma, or prostate carcinoma, and which may stimulate a CTL response whereby the immunogenic peptides associate with HLA-A2, HLA-A1/A11, HLA supertypes, or any class I MHC (i.e., MHC-1) molecule.

The immunogens of the present invention can be in the form of a composition of one or more of the different immunogens and wherein each immunogen is present in any desired relative abundance. Such compositions can be homogeneous or heterogeneous with respect to the individual immunogenic peptide components present therein, having only one or more than one of such peptides.

The oligopeptides and polypeptides useful in practicing the present invention may be derived by fractionation of naturally occurring proteins by methods such as protease treatment, or they may be produced by recombinant or synthetic methodologies that are well known and clear to the skilled artisan (Ausubel, F. M. et al, Current Protocols in Molecular Biology, 1999, John Wiley & Sons, Inc., New York; Coligan, J. E. et al, Current Protocols in Protein Science, 1999, John Wiley & Sons, Inc., New York; Molecular Cloning: A Laboratory Manual, 1989, Cold Spring Harbor Laboratory Press, Cold Spring Harbor). The polypeptide may comprise a recombinant or synthetic polypeptide that comprises at least one of SEQ ID NO:1-86 which sequences may also be present in multiple copies. Thus, oligopeptides and polypeptides of the present invention may have one, two, three, or more such immunogenic peptides within the amino acid sequence of said oligopeptides and polypeptides, and said immunogenic peptides, or epitopes, may be the same or may be different, or may have any number of such sequences wherein some of them are identical to each other in amino acid sequence while others within the same polypeptide sequence are different from each other and said epitopic sequences may occur in any order within said immunogenic polypeptide sequence. The location of such sequences within the sequence of a polypeptide forming an immunogen of the invention may affect relative immunogenic activity. In addition, immunogens of the present invention may comprise more than one protein comprising the amino acid sequences disclosed herein. Such polypeptides may be part of a single composition or may themselves be covalently or non-covalently linked to each other.

The immunogenic peptides disclosed herein may also be linked directly to, or through a spacer or linker to: an immunogenic carrier such as serum albumin, tetanus toxoid, keyhole limpet hemocyanin, dextran, or a recombinant virus particle; an immunogenic peptide known to stimulate a T helper cell type immune response; a cytokine such as interferon gamma or GMCSF; a targeting agent such as an antibody or receptor ligand; a stabilizing agent such as a lipid; or a conjugate of a plurality of epitopes to a branched lysine core structure, such as the so-called "multiple antigenic peptide" described in (Posneft, D. N. et al., J. Biol. Chem., 263:1719-1725, (1988)); a compound such as polyethylene glycol to increase the half life of the peptide; or additional amino acids such as a leader or secretory sequence, or a sequence employed for the purification of the mature sequence. Spacers and linkers typically comprise relatively small, neutral molecules, such as amino acids and which are substantially uncharged under physiological conditions. Such spacers are typically selected from the group of nonpolar or neutral polar amino acids, such as glycine, alanine, serine and other similar amino acids. Such optional spacers or linkers need not comprise the same residues and thus may be either homo- or hetero-oligomers. When present, such linkers will commonly be of length at least one or two, commonly 3, 4, 5, 6, and possibly as much as 10 or even up to 20 residues (in the case of amino acids). In addition, such linkers need not be composed of amino acids but any oligomeric structures will do as well so long as they provide the correct spacing so as to optimize the desired level of immunogenic activity of the immunogens of the present invention. The immunogen may therefore take any form that is capable of eliciting a CTL response.

In addition, the immunogenic peptides of the present invention may be part of an immunogenic structure via attachments other than conventional peptide bonds. Thus, any manner of attaching the peptides of the invention to an immunogen of the invention, such as an immunogenic polypeptide as disclosed herein, could provide an immunogenic structure as claimed herein. Thus, immunogens, such as proteins, oligopeptides and polypeptides of the invention, are structures that contain the peptides disclosed according to the present invention but such immunogenic peptides may not necessarily be attached thereto by the conventional means of using ordinary peptide bounds. The immunogens of the present invention simply contain such peptides as part of their makeup, but how such peptides are to be combined to form the final immunogen is left to the talent and imagination of the user and is in no way restricted or limited by the disclosure contained herein.

The peptides that are naturally processed and bound to a class I MHC molecule, and which are recognized by a tumor-specific CTL, need not be the optimal peptides for stimulating a CTL response. See, for example, (Parkhurst, M. R. et al., J. Immunol., 157:2539-2548, (1996); Rosenberg, S. A. et al., Nat. Med., 4:321-327, (1998)). Thus, there can be utility in modifying a peptide, such that it more readily induces a CTL response. Generally, peptides may be modified at two types of positions. The peptides may be modified at amino acid residues that are predicted to interact with the class I MHC molecule, in which case the goal is to create a peptide that has a higher affinity for the class I MHC molecule than does the original peptide. The peptides can also be modified at amino acid residues that are predicted to interact with the T cell receptor on the CTL, in which case the goal is to create a peptide that has a higher affinity for the T cell receptor than does the original peptide. Both of these types of modifications can result in a variant peptide that is related to an original peptide, but which is better able to induce a CTL response than is the original peptide. As used herein, the term "original peptide" means an oligopeptide with the amino acid sequence selected from SEQ ID NO: 1-86.

The original peptides disclosed herein can be modified by the substitution of one or more residues at different, possibly selective, sites within the peptide chain. Such substitutions may be of a conservative nature, for example, where one amino acid is replaced by an amino acid of similar structure and characteristics, such as where a hydrophobic amino acid is replaced by another hydrophobic amino acid. Even more conservative would be replacement of amino acids of the same or similar size and chemical nature, such as where leucine is replaced by isoleucine. In studies of sequence variations in families of naturally occurring homologous proteins, certain amino acid substitutions are more often tolerated than others, and these often show correlation with similarities in size, charge, polarity, and hydrophobicity between the original amino acid and its replacement, and such is the basis for defining "conservative substitutions."

Conservative substitutions are herein defined as exchanges within one of the following five groups: Group 1—small aliphatic, nonpolar or slightly polar residues (Ala, Ser, Thr, Pro, Gly); Group 2—polar, negatively charged residues and their amides (Asp, Asn, Glu, Gln); Group 3—polar, positively charged residues (His, Arg, Lys); Group 4—large, aliphatic, nonpolar residues (Met, Leu, lie, Val, Cys); and Group 4—large, aromatic residues (Phe, Tyr, Trp).

Less conservative substitutions might involve the replacement of one amino acid by another that has similar characteristics but is somewhat different in size, such as replacement of an alanine by an isoleucine residue. Highly nonconservative replacements might involve substituting an acidic amino acid for one that is polar, or even for one that is basic in character. Such radical substitutions cannot, however, be dismissed as potentially ineffective since chemical effects are not totally predictable and radical substitutions might well give rise to serendipitous effects not otherwise predictable from simple chemical principles.

Of course, such substitutions may involve structures other than the common L-amino acids. Thus, D-amino acids might be substituted for the L-amino acids commonly found in the antigenic peptides of the invention and yet still be encompassed by the disclosure herein. In addition, amino acids possessing non-standard R groups (i.e., R groups other than those found in the common 20 amino acids of natural proteins) may also be used for substitution purposes to produce immunogens and immunogenic polypeptides according to the present invention.

If substitutions at more than one position are found to result in a peptide with substantially equivalent or greater antigenic activity as defined below, then combinations of those substitutions will be tested to determine if the combined substitutions result in additive or syngeneic effects on the antigenicity of the peptide. At most, no more than 4 positions within the peptide would simultaneously be substituted.

Based on cytotoxicity assays, an epitope is considered substantially identical to the reference peptide if it has at least 10% of the antigenic activity of the reference peptide as defined by the ability of the substituted peptide to reconstitute the epitope recognized by a CTL in comparison to the reference peptide. Thus, when comparing the lytic activity in the linear portion of the effector:target curves with equimolar concentrations of the reference and substituted peptides, the observed percent specific killing of the target cells incubated with the substituted peptide should be equal to that of the reference peptide at an effector:target ratio that is no greater than 10-fold above the reference peptide effector:target ratio at which the comparison is being made.

Preferably, when the CTLs specific for a peptide of SEQ ID NO:1-86 are tested against the substituted peptides, the peptide concentration at which the substituted peptides achieve half the maximal increase in lysis relative to background is no more than about 1 mM, preferably no more than about 1 µM, more preferably no more than about 1 nM, and still more preferably no more than about 100 pM, and most preferably no more than about 10 pM. It is also preferred that the substituted peptide be recognized by CTLs from more than one individual, at least two, and more preferably three individuals.

Thus, the epitopes of the present invention may be identical to naturally occurring tumor-associated or tumor-specific epitopes or may include epitopes that differ by no more than 4 residues from the reference peptide, as long as they have substantially identical antigenic activity.

It should be appreciated that an immunogen may consist only of a peptide of SEQ ID NO:1-86, or comprise a peptide of SEQ ID NO:1-86, or comprise a plurality of peptides selected from SEQ ID NO:1-86, or comprise a polypeptide that itself comprises one or more of the epitopic peptides of SEQ ID NO: 1-86.

The immunogenic peptides and polypeptides of the invention can be prepared synthetically, by recombinant DNA technology, or they can be isolated from natural sources such as tumor cells expressing the original protein product.

The polypeptides and oligopeptides disclosed herein can be synthesized in solution or on a solid support in accordance with conventional techniques. Various automated peptide synthesizers are commercially available and can be used in accordance with known protocols. See, for example, (Grant, G. A., Synthetic Peptides: A User's Guide, 1992, W. H. Freeman and Company, New York; Coligan, J. E. et al, Current Protocols in Protein Science, 1999, John Wiley & Sons, Inc., New York). Fragments of polypeptides of the invention can also be synthesized as intermediates in the synthesis of a larger polypeptide.

Recombinant DNA technology may be employed wherein a nucleotide sequence that encodes an immunogenic peptide or polypeptide of interest is inserted into an expression vector, transformed or transfected into an appropriate host cell, and cultivated under conditions suitable for expression. These procedures are well known in the art to the skilled artisan, as described in (Coligan, J. E. et al, Current Protocols in Immunology, 1999, John Wiley & Sons, Inc., New York; Ausubel, F. M. et al, Current Protocols in Molecular Biology, 1999, John Wiley & Sons, Inc., New York; Molecular Cloning: A Laboratory Manual, 1989, Cold Spring Harbor Laboratory Press, Cold Spring Harbor). Thus, recombinantly produced peptides or polypeptides can be used as the immunogens of the invention.

The coding sequences for peptides of the length contemplated herein can be synthesized on commercially available automated DNA synthesizers using protocols that are well know in the art. See for example, (Grant, G. A., Synthetic Peptides: A User's Guide, 1992, W. H. Freeman and Company, New York; Coligan, J. E. et al, Current Protocols in Protein Science, 1999, John Wiley & Sons, Inc., New York). The coding sequences can also be modified such that a peptide or polypeptide will be produced that incorporates a desired amino acid substitution. The coding sequence can be provided with appropriate linkers, be ligated into suitable expression vectors that are commonly available in the art, and the resulting DNA or RNA molecule can be transformed or transfected into suitable hosts to produce the desired fusion protein. A number of such vectors and suitable host systems are available, and their selection is left to the skilled artisan. For expression of the fusion proteins, the coding sequence will be provided with operably linked start and stop codons, promoter and terminator regions, and a replication system to provide an expression vector for expression in the desired host cell. For example, promoter sequences compatible with bacterial hosts are provided in plasmids containing convenient restriction sites for insertion of the desired coding sequence. The resulting expression vectors are transformed into suitable bacterial hosts. Yeast, insect, and mammalian host cells may also be used, employing suitable vectors and control sequences.

Host cells are genetically engineered (transduced or transformed or transfected) with the vectors of this invention which may be, for example, a cloning vector or an expression vector. The vector may be, for example, in the form of a plasmid, a viral particle, a phage, etc. The engineered host cells can be cultured in conventional nutrient media modified as appropriate for activating promoters, selecting transformants or amplifying the genes of the present invention. The culture conditions, such as temperature, pH and the like, are those previously used with the host cell selected for expression, and will be apparent to the ordinarily skilled artisan.

More particularly, the present invention also includes recombinant constructs comprising one or more of the sequences as broadly described above. The constructs comprise a vector, such as a plasmid or viral vector, into which a sequence of the invention has been inserted, in a forward or reverse orientation. In a preferred aspect of this embodiment, the construct further comprises regulatory sequences, including, for example, a promoter, operably linked to the sequence. Large numbers of suitable vectors and promoters are known to those of skill in the art, and are commercially available.

In a further embodiment, the present invention relates to host cells containing the above-described constructs. The host cell can be a higher eukaryotic cell, such as a mammalian cell, or a lower eukaryotic cell, such as a yeast cell, or the host cell can be a prokaryotic cell, such as a bacterial cell. Introduction of the construct into the host cell can be effected by calcium phosphate transfection, DEAE-Dextran mediated transfection, or electroporation (Ausubel, F. M. et al, Current Protocols in Molecular Biology, 1999, John Wiley & Sons, Inc., New York; Molecular Cloning: A Laboratory Manual, 1989, Cold Spring Harbor Laboratory Press, Cold Spring Harbor). Such cells can routinely be utilized for assaying CTL activity by having said genetically engineered, or recombinant, host cells express the immunogenic peptides of the present invention.

Various mammalian cell culture systems can also be employed to express recombinant protein. Examples of mammalian expression systems include the COS-7 lines of monkey kidney fibroblasts, described by Gluzman, Cell, 23:175 (1981), and other cell lines capable of expressing a compatible vector, for example, the C127, 3T3, CHO, HeLa and BHK cell lines. Mammalian expression vectors will comprise an origin of replication, a suitable promoter and enhancer, and also any necessary ribosome binding sites, polyadenylation site, splice donor and acceptor sites, transcriptional termination sequences, and 5' flanking non-transcribed sequences. DNA sequences derived from the SV40 splice, and polyadenylation sites may be used to provide the required nontranscribed genetic elements.

The polypeptide can be recovered and purified from recombinant cell cultures by methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Protein refolding steps can be used, as necessary, in completing configuration of the mature protein. High performance liquid chromatography (HPLC) can be employed for final purification steps.

The immunogenic peptides of the present invention may be used to elicit CTLs ex vivo from either healthy individuals or from cancer patients, such as breast carcinoma, colorectal carcinoma, lung carcinoma, ovarian carcinoma, or prostate carcinoma. Such responses are induced by incubating in tissue culture the individual's CTL precursor lymphocytes together with a source of antigen presenting cells and the appropriate immunogenic peptide. Examples of suitable antigen presenting cells include dendritic cells, macrophages, and activated B cells. Typically, the peptide at concentrations between 10 and 40 µg/ml, would be pre-incubated with the antigen presenting cells for periods ranging from 1 to 18 hrs. $\beta_2$-microglobulin (4 µg/ml) can be added during this time period to enhance binding. The antigen presenting cells may also be held at room temperature during the incubation period (Ljunggren, H.- G. et al., Nature, 346:476-480, (1990)) or pretreated with acid (Zeh, H. J., III et al., Hum. Immunol., 39:79-86, (1994)) to promote the generation of denatured class I MHC molecules that can then bind the peptide. The precursor CTLs (responders) are then added to the antigen presenting cells to which the immunogenic peptide has bound (stimulators) at responder to stimulator ratios of between 5:1 and 50:1, and most typically between 10:1 and 20:1. The co-cultivation of the cells is carried out at 37° C. in RPMI 1640, 10% fetal bovine serum, 2 mM L-glutamine, and IL-2 (5-20 Units/ml). Other cytokines, such as IL-1, IL-7, and IL-12 may also be added to the culture. Fresh IL-2-containing media is added to the cultures every 2-4 days, typically by removing one-half the old media and replenishing it with an equal volume of fresh media. After 7-10 days, and every 7-10 days thereafter, the CTL are re-stimulated with antigen presenting cells to which immunogenic peptide has been bound as described above. Fresh IL-2-containing media is added to the cells throughout their culture as described above. Three to four rounds of stimulation, and sometimes as many five to eight rounds of stimulation, are required to generate a CTL response that can then be measured in vitro. The above described protocol is illustrative only and should not be considered limiting. Many in vitro CTL stimulation protocols have been described and the choice of which one to use is well within the knowledge of the skilled artisan. The peptide-specific CTL can be further expanded to large numbers by treatment with anti-CD3 antibody. For example, see (Riddell, S. R. and Greenberg, P. D., J. Immunol. Methods, 128:189-201, (1990); Walter, E. A. et al., N. Engl. J. Med., 333:1038-1044, (1995)).

Antigen presenting cells that are to be used to stimulate a CTL response are typically incubated with peptide of an optimal length, for example a nonapeptide, that allows for direct binding of the peptide to the class I MHC molecule without additional processing. Larger oligopeptides and polypeptides are generally ineffective in binding to class I MHC molecules as they are not efficiently processed into an appropriately sized peptide in the extracellular milieu. A variety of approaches are known in the art, however, that allow oligopeptides and polypeptides to be exogenously acquired by a cell, which then allows for their subsequent processing and presentation by a class I MHC molecule. Representative, but non-limiting examples of such approaches include electroporation of the molecules into the cell (Harding, C. H. III, Eur. J. Immunol., 22:1865-1869, (1992)), encapsulation of the molecules in liposomes that are fused to the cells of interest (Reddy, R. et al., J. Immunol. Methods, 141:157-163, (1991)), or osmotic shock in which the molecules are taken up via pinocytosis (Moore, M. W. et al., Cell, 54:777-785, (1988)). Thus, oligopeptides and polypeptides that comprise one or more of the peptides of the invention can be provided to antigen presenting cells in such a fashion that they are delivered to the cytoplasm of the cell, and are subsequently processed to allow presentation of the peptides.

Antigen presenting cells suitable for stimulating an in vitro CTL response that is specific for one or more of the peptides of the invention can also be prepared by introducing polynucleotide vectors encoding the sequences into the cells. These polynucleotides can be designed such that they express only a single peptide of the invention, multiple peptides of the invention, or even a plurality of peptides of the invention. A variety of approaches are known in the art that allow polynucleotides to be introduced and expressed in a cell, thus providing one or more peptides of the invention to the class I MHC molecule binding pathway. Representative, but non-limiting examples of such approaches include the introduction of plasmid DNA through particle-mediated gene transfer or electroporation (Tuting, T. et al., J. Immunol., 160:1139-1147, (1998)), or the transduction of cells with an adenovirus expressing the polynucleotide of interest (Perez-Diez, A. et al., Cancer Res., 58:5305-5309, (1998)). Thus, oligonucleotides that code for one or more of the peptides of the invention can be provided to antigen presenting cells in such a fashion that the peptides associate with class I MHC molecules and are presented on the surface of the antigen presenting cell, and consequently are available to stimulate a CTL response.

By preparing the stimulator cells used to generate an in vitro CTL response in different ways, it is possible to control the peptide specificity of CTL response. For example, the CTLs generated with a particular peptide will necessarily be specific for that peptide. Likewise, CTLs that are generated with a polypeptide or polynucleotide expressing or coding for particular peptides will be limited to specificities that recognize those peptides. More broadly, stimulator cells, and more specifically dendritic cells, can be incubated in the presence of the whole parent protein. As a further alternative, stimulator cells, and more specifically dendritic cells, can be transduced or transfected with RNA or DNA comprising the polynucleotide sequence encoding the protein. Under these alternative conditions, peptide epitopes that are naturally cleaved out of the protein, and which are generated in addition to peptide epitopes of SEQ ID NO:1-86 can associate with an appropriate class I MHC molecule, which may or may not include HLA-A1, -A2, -A3. The selection of antigen presenting cells and the type of antigen with which to stimulate the CTL, is left to the ordinary skilled artisan.

In certain embodiments, the methods of the present invention include a method for inducing a CTL response in vitro that is specific for a tumor cell expressing a molecule from A1, A2, or A3 supertypes (A11 is a member of the A3 supertype), whereby the method comprises contacting a CTL precursor lymphocyte with an antigen presenting cell that has bound an immunogen comprising one or more of the peptides disclosed according to the invention.

In specific embodiments, the methods of the present invention include a method for inducing a CTL response in vitro that is specific for a tumor cell expressing a molecule from A1, A2, or A3 supertypes, whereby the method comprises contacting a CTL precursor lymphocyte with an antigen presenting cell that has exogenously acquired an immunogenic oligopeptide or polypeptide that comprises one or more of the peptides disclosed according to the invention.

A yet additional embodiment of the present invention is directed to a process for inducing a CTL response in vitro that is specific for a tumor cell expressing a molecule from A1, A2, or A3 supertypes, comprising contacting a CTL precursor lymphocyte with an antigen presenting cell that is expressing a polynucleotide coding for a polypeptide of the invention and wherein said polynucleotide is operably linked to a promoter.

A variety of techniques exist for assaying the activity of CTL. These techniques include the labeling of target cells with radionuclides such as $Na_2^{51}CrO_4$ or $^3H$-thymidine, and measuring the release or retention of the radionuclides from the target cells as an index of cell death. Such assays are well-known in the art and their selection is left to the skilled artisan. Alternatively, CTL are known to release a variety of cytokines when they are stimulated by an appropriate target cell, such as a tumor cell expressing the relevant class I MHC molecule and the corresponding peptide. Non-limiting examples of such cytokines include IFN-γ, TNF-α, and GM-CSF. Assays for these cytokines are well known in the art, and their selection is left to the skilled artisan. Methodology for measuring both target cell death and cytokine release as a measure of CTL reactivity are given in Coligan, J. E. et al. (Current Protocols in Immunology, 1999, John Wiley & Sons, Inc., New York).

After expansion of the antigen-specific CTLs, the latter are then adoptively transferred back into the patient, where they will destroy their specific target cell. The utility of such adoptive transfer is demonstrated in North, R. J. et al. (Infect. Immun., 67:2010-2012, (1999)) and Riddell, S. R. et al. (Science, 257:238-241, (1992)). In determining the amount of cells to reinfuse, the skilled physician will be guided by the total number of cells available, the activity of the CTL as measured in vitro, and the condition of the patient. Preferably, however, about $1\times10^6$ to about $1\times10^{12}$, more preferably about $1\times10^8$ to about $1\times10^{11}$, and even more preferably, about $1\times10^9$ to about $1\times10^{10}$ peptide-specific CTL are infused. Methodology for reinfusing T cells into a patient are well known and exemplified in U.S. Pat. No. 4,844,893 to Honski, et al., and U.S. Pat. No. 4,690,915 to Rosenberg.

The peptide-specific CTL can be purified from the stimulator cells prior to infusion into the patient. For example, monoclonal antibodies directed toward the cell surface protein CD8, present on CTL, can be used in conjunction with a variety of isolation techniques such as antibody panning, flow cytometric sorting, and magnetic bead separation to purify the peptide-specific CTL away from any remaining non-peptide specific lymphocytes or from the stimulator cells. These methods are well known in the art, and their selection is left to the skilled artisan. It should be appreciated that generation of peptide-specific CTL in this manner obviates the need for stimulating the CTL in the presence of tumor. Thus, there is no chance of inadvertently reintroducing tumor cells into the patient.

Thus, one embodiment of the present invention relates to a process for treating a subject with cancer characterized by tumor cells expressing complexes of a molecule from A1, A2, or A3 supertypes, for example, HLA-A1, HLA-A2, or HLAA11, whereby CTLs produced in vitro according to the present invention are administered in an amount sufficient to destroy the tumor cells through direct lysis or to effect the destruction of the tumor cells indirectly through the elaboration of cytokines.

Another embodiment of the present invention is directed to a process for treating a subject with cancer characterized by tumor cells expressing any class I MHC molecule and an epitope of SEQ ID NO: 1-86, whereby the CTLs are produced in vitro and are specific for the epitope or original protein and are administered in an amount sufficient to destroy the tumor cells through direct lysis or to effect the destruction of the tumor cells indirectly through the elaboration of cytokines.

In the foregoing embodiments the cancer to be treated may include a breast carcinoma, a colorectal carcinoma, an ovarian carcinoma, a lung carcinoma, and prostate carcinoma, but especially lung carcinoma.

The ex vivo generated CTL can be used to identify and isolate the T cell receptor molecules specific for the peptide. The genes encoding the alpha and beta chains of the T cell receptor can be cloned into an expression vector system and transferred and expressed in naive T cells from peripheral blood, T cells from lymph nodes, or T lymphocyte progenitor cells from bone marrow. These T cells, which would then be expressing a peptide-specific T cell receptor, would then have anti-tumor reactivity and could be used in adoptive therapy of cancer, and more specifically cancer, breast carcinoma, colorectal carcinoma, ovarian carcinoma, lung carcinoma, and prostate carcinoma.

In addition to their use for therapeutic or prophylactic purposes, the immunogenic peptides of the present invention are useful as screening and diagnostic agents. Thus, the immunogenic peptides of the present invention, together with modern techniques of gene screening, make it possible to screen patients for the presence of genes encoding such peptides on cells obtained by biopsy of tumors detected in such patients. The results of such screening may help determine the efficacy of proceeding with the regimen of treatment disclosed herein using the immunogens of the present invention.

Alternatively, the immunogenic peptides disclosed herein, as well as functionally similar homologs thereof, may be used to screen a sample for the presence of CTLs that specifically recognize the corresponding epitopes. The lymphocytes to be screened in this assay will normally be obtained from the peripheral blood, but lymphocytes can be obtained from other sources, including lymph nodes, spleen, tumors, and pleural fluid. The peptides of the present invention may then be used as a diagnostic tool to evaluate the efficacy of the immunotherapeutic treatments disclosed herein. Thus, the in vitro generation of CTL as described above would be used to determine if patients are likely to respond to the peptide in vivo. Similarly, the in vitro generation of CTL could be done with samples of lymphocytes obtained from the patient before and after treatment with the peptides. Successful generation of CTL in vivo should then be recognized by a correspondingly easier ability to generate peptide-specific CTL in vitro from lymphocytes obtained following treatment in comparison to those obtained before treatment.

The oligopeptides of the invention, such as SEQ ID NO: 1-86, can also be used to prepare class I MHC tetramers which can be used in conjunction with flow cytometry to quantitate the frequency of peptide-specific CTL that are present in a sample of lymphocytes from an individual. Specifically, for example, class I MHC molecules comprising peptides of SEQ ID NO: 1-86, would be combined to form tetramers as exemplified in U.S. Pat. No. 5,635,363. Said tetramers would find use in monitoring the frequency of CTLs in the peripheral blood, lymph nodes, or tumor mass of an individual undergoing immunotherapy with the peptides, proteins, or polynucleotides of the invention, and it would be expected that successful immunization would lead to an increase in the frequency of the peptide-specific CTL.

As stated above, a vaccine in accordance with the present invention may include one or more of the hereinabove described polypeptides or active fragments thereof, or a composition, or pool, of immunogenic peptides disclosed herein. When employing more than one polypeptide or active fragment, such as two or more polypeptides and/or active fragments may be used as a physical mixture or as a fusion of two or more polypeptides or active fragments. The fusion fragment or fusion polypeptide may be produced, for example, by recombinant techniques or by the use of appropriate linkers for fusing previously prepared polypeptides or active fragments.

The immunogenic molecules of the invention, including vaccine compositions, may be utilized according to the present invention for purposes of preventing, suppressing or treating diseases causing the expression of the immunogenic peptides disclosed herein, such as where the antigen is being expressed by tumor cells. As used in accordance with the present invention, the term "prevention" relates to a process of prophylaxis in which an animal, especially a mammal, and most especially a human, is exposed to an immunogen of the present invention prior to the induction or onset of the disease process. This could be done where an individual has a genetic pedigree indicating a predisposition toward occurrence of the disease condition to be prevented. For example, this might be true of an individual whose ancestors show a predisposition toward certain types of cancer. Alternatively, the immunogen could be administered to the general population as is frequently done for infectious diseases. Alternatively, the term "suppression" is often used to describe a condition wherein the disease process has already begun but obvious symptoms of said condition have yet to be realized. Thus, the cells of an individual may have become cancerous but no outside signs of the disease have yet been clinically recognized. In either case, the term prophylaxis can be applied to encompass both prevention and suppression. Conversely, the term "treatment" is often utilized to mean the clinical application of agents to combat an already existing condition whose clinical presentation has already been realized in a patient. This would occur where an individual has already been diagnosed as having a tumor.

It is understood that the suitable dosage of an immunogen of the present invention will depend upon the age, sex, health, and weight of the recipient, the kind of concurrent treatment, if any, the frequency of treatment, and the nature of the effect desired. However, the most preferred dosage can be tailored to the individual subject, as determined by the researcher or clinician. The total dose required for any given treatment will commonly be determined with respect to a standard reference dose as set by a manufacturer, such as is commonly done with vaccines, such dose being administered either in a single treatment or in a series of doses, the success of which will depend on the production of a desired immunological result (i.e., successful production of a CTL-mediated response to the antigen, which response gives rise to the prevention and/or treatment desired). Thus, the overall administration schedule must be considered in determining the success of a course of treatment and not whether a single dose, given in isolation, would or would not produce the desired immunologically therapeutic result or effect.

The therapeutically effective amount of a composition containing one or more of the immunogens of this invention, is an amount sufficient to induce an effective CTL response to cure or arrest disease progression. Thus, this dose will depend, among other things, on the identity of the immunogens used, the nature of the disease condition, the severity of the disease condition, the extent of any need to prevent such a condition where it has not already been detected, the manner of administration dictated by the situation requiring such administration, the weight and state of health of the individual receiving such administration, and the sound judgment of the clinician or researcher. Thus, for purposes of prophylactic or therapeutic administration, effective amounts would generally lie within the range of from 1.0 µg to about 5,000 µg of peptide for a 70 kg patient, followed by boosting dosages of from about 1.0 µg to about 1,000 µg of peptide pursuant to a boosting regimen over days, weeks or months, depending on the recipient's response and as necessitated by subsequent monitoring of CTL-mediated activity within the bloodstream. Of course, such dosages are to be considered only a general guide and, in a given situation, may greatly exceed such suggested dosage regimens where the clinician believes that the recipient's condition warrants more aggressive administration schedule. The efficacy of administering additional doses, and of increasing or decreasing the interval, may be re-evaluated on a continuing basis, in view of the recipient's immunocompetence (for example, the level of CTL activity with respect to tumor-associated or tumor-specific antigens).

For such purposes, the immunogenic compositions according to the present invention may be used against a disease condition such as cancer by administration to an individual by a variety of routes. The composition may be administered parenterally or orally, and, if parenterally, either systemically or topically. Parenteral routes include subcutaneous, intravenous, intradermal, intramuscular, intraperitoneal, intranasal, transdermal, or buccal routes. One or more such routes may be employed. Parenteral administration can be, for example, by bolus injection or by gradual perfusion over time.

Generally, vaccines are prepared as injectables, in the form of aqueous solutions or suspensions. Vaccines in an oil base are also well known such as for inhaling. Solid forms that are dissolved or suspended prior to use may also be formulated.

Pharmaceutical carriers, diluents and excipients are generally added that are compatible with the active ingredients and acceptable for pharmaceutical use. Examples of such carriers include, but are not limited to, water, saline solutions, dextrose, or glycerol. Combinations of carriers may also be used. These compositions may be sterilized by conventional, well known sterilization techniques including sterile filtration. The resulting solutions may be packaged for use as is, or the aqueous solutions may be lyophilized, the lyophilized preparation being combined with sterile water before administration. Vaccine compositions may further incorporate additional substances to stabilize pH, or to function as adjuvants, wetting agents, or emulsifying agents, which can serve to improve the effectiveness of the vaccine.

The concentration of the CTL stimulatory peptides of the invention in pharmaceutical formulations are subject to wide variation, including anywhere from less than 0.01% by weight to as much as 50% or more. Factors such as volume and viscosity of the resulting composition must also be considered. The solvents, or diluents, used for such compositions include water, dimethylsulfoxide, PBS (phosphate buffered saline), or saline itself, or other possible carriers or excipients.

The immunogens of the present invention may also be contained in artificially created structures such as liposomes, ISCOMS, slow-releasing particles, and other vehicles which increase the immunogenicity and/or half-life of the peptides or polypeptides in serum. Liposomes include emulsions, foams, micelles, insoluble monolayers, liquid crystals, phospholipid dispersions, lamellar layers and the like. Liposomes for use in the invention are formed from standard vesicle-forming lipids which generally include neutral and negatively charged phospholipids and a sterol, such as cholesterol. The selection of lipids is generally determined by considerations such as liposome size and stability in the blood. A variety of methods are available for preparing liposomes as reviewed, for example, by (Coligan, J. E. et al, Current Protocols in Protein Science, 1999, John Wiley & Sons, Inc., New York) and see also U.S. Pat. Nos. 4,235,871, 4,501,728, 4,837,028, and 5,019,369. Liposomes containing the peptides or polypeptides of the invention can be directed to the site of lymphoid cells where the liposomes then deliver the selected immunogens directly to antigen presenting cells. Targeting can be achieved by incorporating additional molecules such as proteins or polysaccharides into the outer membranes of said structures, thus resulting in the delivery of the structures to particular areas of the body, or to particular cells within a given organ or tissue. Such targeting molecules may a molecule that binds to receptor on antigen presenting cells. For example an antibody that binds to CD80 could be used to direct liposomes to dendritic cells.

The immunogens of the present invention may also be administered as solid compositions. Conventional nontoxic solid carriers including pharmaceutical grades of mannitol, lactose, starch, magnesium, cellulose, glucose, sucrose, sodium saccharin, and the like. Such solid compositions will often be administered orally, whereby a pharmaceutically acceptable nontoxic composition is formed by incorporating the peptides and polypeptides of the invention with any of the carriers listed above. Generally, such compositions will contain 10-95% active ingredient, and more preferably 25-75% active ingredient.

Aerosol administration is also an alternative, requiring only that the immunogens be properly dispersed within the aerosol propellant. Typical percentages of the peptides or polypeptides of the invention are 0.01%-20% by weight, preferably 1%-10%. The use of a surfactant to properly disperse the immunogen may be required. Representative surfactants include the esters or partial esters of fatty acids containing from 6 to 22 carbon atoms, such as caproic, octanoic, lauric, palmitic, stearic, linoleic, linolenic, olesteric and oleic acids with an aliphatic polyhydric alcohol or its cyclic anhydride. Mixed esters, such as mixed or natural glycerides may be employed. The surfactant may constitute 0.1-20% by weight of the composition, preferably 0.25-5%. Typical propellants for such administration may include esters and similar chemicals but are by no means limited to these. A carrier, such as lecithin for intranasal delivery, may also be included.

The peptides and polypeptides of the invention may also be delivered with an adjuvant. Adjuvants include, but are not limited to, complete or incomplete Freund's adjuvant, Montanide ISA-51, Activation Gene-3 (LAG-3), aluminum phosphate, aluminum hydroxide, alum, and saponin. Adjuvant effects can also be obtained by injecting a variety of cytokines along with the immunogens of the invention. These cytokines include, but are not limited to IL-1, IL-2, IL-7, IL-12, and GM-CSF.

The peptides and polypeptides of the invention can also be added to professional antigen presenting cells such as dendritic cells that have been prepared ex vivo. For example, the dendritic cells could be prepared from CD34 positive stem cells from the bone marrow, or they could be prepared from CD14 positive monocytes obtained from the peripheral blood. The dendritic cells are generated ex vivo using cytokines such as GM-CSF, IL-3, IL-4, TNF, and SCF. The cultured DC are then pulsed with peptides at various concentrations using standard methods that are well known in the art. The peptide-pulsed dendritic cells can then be administered either intravenously, subcutaneously, or intradermally, and the immunization may also include cytokines such as IL-2 or IL-12.

The present invention is also directed to a vaccine in which an immunogen of the present invention is delivered or administered in the form of a polynucleotide encoding the a polypeptide or active fragment as disclosed herein, whereby the peptide or polypeptide or active fragment is produced in vivo. The polynucleotide may be included in a suitable expression vector and combined with a pharmaceutically acceptable carrier. For example, the peptides or polypeptides could be expressed in plasmid DNA and nonreplicative viral vectors such as vaccinia, fowlpox, Venezuelan equine encephalitis virus, adenovirus, or other RNA or DNA viruses. These examples are meant to be illustrative only and should not be viewed as self-limiting. A wide variety of other vectors is available and are apparent to those skilled in the art from the description given herein. In this approach, a portion of the nucleotide sequence of the viral vector is engineered to express the peptides or polypeptides of the invention. Vaccinia vectors and methods useful in immunization protocols are described in U.S. Pat. No. 4,722,848, the disclosure of which is incorporated herein by reference in its entirety.

Regardless of the nature of the composition given, additional therapeutic agents may also accompany the immunogens of the present invention. Thus, for purposes of treating tumors, compositions containing the immunogens disclosed herein may, in addition, contain other antitumor pharmaceuticals. The use of such compositions with multiple active ingredients is left to the discretion of the clinician.

In addition, the immunogens of the present invention can be used to stimulate the production of antibodies for use in passive immunotherapy, for use as diagnostic reagents, and for use as reagents in other processes such as affinity chromatography.

The present invention also relates to antibodies that react with immunogens, such as a polypeptide comprising one or more of the epitopic peptides of SEQ ID NO: 1-86 as disclosed herein. Active fragments of such antibodies are also specifically contemplated. Such antibodies, and active fragments of such antibodies, for example, and Fab structure, may react with, including where it is highly selective or specific for, an immunogenic structure comprising 2, 3, 4 or more of the epitopic peptides of the invention.

With the advent of methods of molecular biology and recombinant technology, it is now possible for the artisan or ordinary skill to produce antibody molecules by recombinant means and thereby generate gene sequences that code for specific amino acid sequences found in the polypeptide structure of the antibodies. Such antibodies can be produced by either cloning the gene sequences encoding the polypeptide chains of said antibodies or by direct synthesis of said polypeptide chains, with in vitro assembly of the synthesized chains to form active tetrameric ($H_2L_2$) structures with affinity for specific epitopes and antigenic determinants. This has permitted the ready production of antibodies having sequences characteristic of neutralizing antibodies from different species and sources.

Regardless of the source of the antibodies or nanobodies, or how the artisan of ordinary skill chooses to produce such antibodies or nanobodies, including recombinantly constructed or synthesized, in vitro or in vivo, by using transgenic animals, such as cows, goats and sheep, or by using cell cultures in bioreactors, or by direct chemical synthesis employing no living organisms at any stage of the process, all antibodies and nanobodies have regions capable of interacting with a structurally complementary antigenic target. The regions interacting with the target are referred to as "variable" or "V" regions and are characterized by differences in amino acid sequence from antibodies of different antigenic specificity.

The antibodies disclosed according to the invention may also be wholly synthetic, wherein the polypeptide chains of the antibodies are synthesized and, possibly, optimized for binding to the polypeptides disclosed herein as being receptors. Such antibodies may be chimeric or humanized antibodies and may be fully tetrameric in structure, or may be dimeric and comprise only a single heavy and a single light chain. Such antibodies may also include fragments, such as Fab and $F(ab_2)'$ fragments, capable of reacting with and binding to any of the polypeptides disclosed herein as being receptors.

A further embodiment of the present invention relates to a method for inducing a CTL response in a subject comprising administering to subjects that express HLA A1, A2 or A3 supertype antigens an effective (i.e., CTL-stimulating amount) of an immunogen of the invention that does not comprise the entire protein expressing the epitopic peptides disclosed herein (i.e., one that comprises less than the entire protein where the protein is a naturally occurring polypeptide) in an amount sufficient to induce a CTL response to tumor cells expressing at least HLA-A1 or HLA-A2, as the case may be, thereby eliciting a cellular response against said tumor cells.

A still further embodiment of the present invention relates to a method for inducing a CTL response in a subject, wherein the immunogen is in the form of a polynucleotide. In one non-limiting example, the method comprises administering to subjects that express HLA-A2 at least one CTL epitope, wherein said epitope or epitopes are selected from a group comprising the peptides disclosed according to the invention, and are coded within a polynucleotide sequence that does not comprise the entire protein coding region, in an amount sufficient to induce a CTL response to tumor cells expressing HLA-A2.

While the examples are provided below to illustrate the invention, it is to be understood that these methods and examples in no way limit the invention to the embodiments described herein and that other embodiments and uses will no doubt suggest themselves to those skilled in the art. All publications, patents, and patent applications cited herein are hereby incorporated by reference, as are the references cited therein. It is also to be understood that throughout this disclosure where the singular is used, the plural may be inferred and vice versa and use of either is not to be considered limiting.

Example 1

Cell Lines

Adenocarcinoma lung cancer cell lines CRL-5865 and CRL-5944, were obtained from ATCC (Manassas, Va.) and cultured according to the ATCC protocol.

Example 2

Immunoaffinity Purification

CRL-5865 and CRL-5944 were maintained in RPMI 1640 medium containing 10% heat-inactivated FBS, 2 mM L-glutamine, 10 mM HEPES, penicillin (100 U/ml)—streptomycin (50 ng/ml) solution and 1% sodium pyruvate solution (all from Sigma, St Louis, Mo.). The cells were harvested by treatment with 0.45% trypsin and 0.32 mM EDTA, washed two times in phosphate-buffered saline solution (pH 7.4), and stored as cell pellets at −80° C. Aliquots of 6-8×10$^{10}$ cells were solubilized at 5-10×10$^6$ cells/ml in 20 mM Tris, pH 8.0, 150 mM NaCl, 1% CHAPS, 18.5 μg/ml iodoacetamide, 5 μg/ml aprotonin, 10 μg/ml leupeptin, 10 μg/ml pepstatin A, 5 mM EDTA, 0.2% sodium azide, and 17.4 μg/ml phenylmethylsulfonyl fluoride for 1 h. This and all subsequent steps were performed with ice-cold solutions and at 4° C. The lysates were then centrifuged at 100,000×g, the pellets discarded, and the supernatants passed through a 0.22 μm filter. The supernatants were then passed over a series of columns with the first containing Sepharose, and the second containing the pan MHC class I-specific monoclonal antibody, W632, bound to a protein A-Sepharose matrix. The second column was then sequentially washed with 20 column volumes of 20 mM Tris, pH 8.0, 150 mM NaCl, 20 column volumes of 20 mM Tris, pH 8.0, 1.0 M NaCl, and 20 column volumes of 20 mM Tris, pH 8.0. The peptides were eluted from the column with 5 column volumes of 10% acetic acid. The isolated MHC class I molecules were then boiled for 5 min to further dissociate any bound peptide from the heavy chains. The peptides were then separated from the co-purifying class I heavy chain and β$_2$-microglobulin by centrifugation on a Ultrafree-CL membrane with a nominal molecular weight cut-off of 5,000 Daltons (Millipore, Bedford, Mass.).

Example 3

Purification and Fractionation of MHC Peptides

The isolated MHC Class I molecules were acidified with 10% Acetic acid (AcOH) and the sample solution was heated at 85° C. for 15 min to further dissociate any bound peptide from the heavy chains. Then the solution was cooled to room temperature. The peptides were then separated from the co-purifying class I heavy chain and β$_2$-microglobulin by centrifugation on an Amicon Ultra-3 kDa device and washed with 2 mL of 10% AcOH to obtain maximum number of MHC peptides. The peptide mixture was fractionated (30 fractions) by RPC (Reversed Phase Chromatography) using an off-line Dionex HPLC with C-18 analytical column (Acclaim 300, 4.6 mm ID×150 mm) The peptide fractions were concentrated by vacuum centrifugation from about 400 ul down to 6 μl and further purified by C-18 Zip Tip (Millipore) Analysis.

Example 4

Mass Spectrometry Analysis

Purified peptide fractions were injected individually into Dionex-LCQ LC-MS/MS system individually to identify the MHC peptides. As a part of on-line sample clean-up step, the peptides were first concentrated by a C-18 trap column (Dionex) and then separated by using a 75 um ID×15 cm C18 analytical column (Dionex) equilibrated in 4% ACN/0.1% FA at 250 nL/min flow rate. Mobile phase A was 2% ACN and 0.1% FA in water, while mobile phase B was 0.1% FA and 90% ACN in water. The gradient was 4% to 50% B in 60 min and 50% to 80% in 90 min. MHC peptides and their corresponding proteins were identified by searching the raw data in swissprot human database using proteome discoverer software (Thermo). Some of the key parameters used to filter these search results are: Xcorr (+1:1.5, +2:2.0, and +3:2.5), molecular weight (m/z 700 Da-1300 Da) and peptide mass accuracy ($\Delta 1.5$ Da). The search results were also verified manually to confidently identify the correct peptide sequence.

Example 5

Homology Searches of Identified Peptide Sequences

Proteins containing peptides corresponding to the masses identified by MS were analyzed with the search algorithm, SEQUEST. Searches were carried using SwissProt, a curated human protein database. Table 3 describes SEQ ID NO: 1-86, which are MHC-associated peptides (active fragments) isolated from CRL-5865 and/or CRL-5944.

Example 6

Peptide Synthesis

Peptides were synthesized using a Gilson (Madison, Wis.) AMS 422 multiple peptide synthesizer. Quantities of 10 μMol were synthesized using conventional FMOC amino acids, resins, and chemical techniques. Peptides were purified by RP-HPLC using a 4.6 mm×100 mm POROS (Perseptive Biosystems, Cambridge, Mass.) column and a 10 min, 0-60% acetonitrile in 0.1% TFA gradient.

Example 7

Generation of Monocyte-Derived DC and Peptide Loading

PBMC were purified from HLA-A2$^+$ normal donor blood using lymphocyte separation media (Cappel ICN Biomedical, Aurora, Ohio). PBMC ($5.3 \times 10^6$) were added to individual wells of a 24-well cluster plate (Costar, Corning, N.Y.) in 1.0 ml of serum-free AIM-V medium (Life Technologies) and allowed to adhere for 60 min at 37° C. Non-adherent cells were removed and saved as a source of effector T cells. Adherent PBMC (~$8.3 \times 10^5$/well) were then pulsed with 50 mg/ml synthetic peptides in serum-free AIM-V medium containing 1.5 mg/ml $\beta_2$-microglobulin (Calbiochem-Novabiochem, San Diego, Calif.) and incubated for 2 h at 37° C. Unbound peptides were aspirated and the wells washed with media.

Monocyte-derived DC were generated as follows. PBMC ($5.3 \times 10^7$) were allowed to adhere in T-75 flasks (Corning) in 10 ml of serum-free AIM-V medium for 60 min at 37° C. Non-adherent cells were collected as a source of effector T cells and pooled with the previous collection above. Adherent monocytes in flasks were then exposed to recombinant human granulocyte macrophage colony stimulating factor (GM-CSF, 25 ng/ml; Peprotech) and recombinant human IL-4 (100 ng/ml; Peprotech) in 10 ml of AIM-V medium containing 10% heat-inactivated FBS. DC obtained by this method [immature DC (iDC)] are characterized by expression of low levels of CD83, CD80, CD86, and HLA class I and class II molecules (data not shown).

Mature DC (mDC) were obtained by exposing day 5 DC cultures to recombinant soluble CD40 ligand (sCD40L; Peprotech) at 1.5 mg/ml for 24 h in the presence of 25 ng/ml GM-CSF and are characterized by expression of high levels of CD80, CD86, and HLA class I and class II molecules. mDC were harvested, washed, pulsed with 5 mg/ml peptide in serum-free AIM-V medium and irradiated (5000 rad) prior to use as stimulators.

Example 8

Generation of Peptide-Specific CTL

The protocol used here is a modification of the method described by Plebanski et al. (Eur. J. Immunol. 25:1783, (1995)). CTL to peptide were generated by 3±4 cycles of stimulation with peptide-loaded APC. For the first round of stimulation (day 0), T cells or non-adherent PBMC from above ($2.3 \times 10^6$/ml or $4.3 \times 10^6$ per well) were added in bulk (CD4$^+$, CD8$^+$, NK, etc.) to adherent PBMC-loaded peptides in serum-free medium (50 mg/ml), $\beta_2$-microglobulin (1.5 mg/ml) (Calbiochem-Novabiochem), recombinant human IL-7 (5 ng/ml) (Peprotech) and keyhole limpet hemocyanin (5 mg/ml) (Sigma, St Louis, Mo.). Cultures were re-stimulated with iDC every 7 days, pulsed with varying amounts of peptide (second round 25 mg/ml, third round 10 mg/ml) and irradiated (5000 rad) on day 8. At each re-stimulation, the T cells were transferred to new plates by first aspirating 70% of spent media in wells and then transferring the pooled contents to a new plate. Fresh IL-7 was added at each re-stimulation. The responder:stimulator (T cell:DC) ratio was set at 20 for each stimulation. Recombinant human IL-2 (10 U/ml) was added on day 5 after each re-stimulation.

Prior to CTL assays, the T cells were harvested and CD8$^+$ T cells were purified by positive selection using CD8$^+$ microbeads immunomagnetic cell separation with MACS kit (Miltenyi Biotec, Auburn, Calif.). If a fourth round of stimulation was necessary following CTL analysis, the CTL were pulsed as before, except with 5±10 mg/ml of peptide.

Example 9

Evaluation of CTL Response

The peptide specific CTLs were assessed for recognition and/or lysis of peptide-loaded T2 cells as well as various lung normal and tumor target cells. After two to four rounds of restimulation, cultures were tested for cytotoxic activity against the peptide loaded and normal and tumor targets. Peptide-pulsed T2 cells (1 μg/ml peptide for 2 hr at 37° C.), irrelevant HLA-A2 peptides pulsed T2 cells were used as controls. Recognition of specific antigens by peptide-specific CTL was measured by production of IFN-gamma and granzyme in the ELISPOT assay (Ramakrishna, V., M. M. Ross, M. Petersson, C. C. Gatlin, C. E. Lyons, C. L. Miller, H. E. Myers, M. McDaniel, L. R. Karns, R. Kiessling, G. Parmiani, and D.C. Flyer. (2003) Int Immunol 15:751-763; Morse, M. A., S. K. Nair, P. J. Mosca, A. C. Hobeika, T. M. Clay, Y. Deng, D. Boczkowski, A. Proia, D. Neidzwiecki, P. A. Clavien, H. I. Hurwitz, J. Schlom, E. Gilboa, and H. K. Lyerly. (2003) Cancer Invest 21:341-349). Appropriate controls, including peptide-unpulsed T2 and PHA to stimulate non-specific IFN-gamma induction by the CTLs as negative and positive controls were included in all assays.

Example 10

Lung Epitopes Specific CTL Characterization

Eight epitopes based on their HLA-A2 motif and significance of the parent proteins in cancer pathways were selected for CTL characterization (Table 2). Synthetic peptides were made and used for CTL analysis.

PBMC from two healthy HLA-A2+ donors were in vitro stimulated with synthetic peptides corresponding to each of the eight lung cancer epitopes. These cells were tested in an ELISpot assay using T2 cells loaded with the corresponding synthetic peptide, normal cell suspensions obtained from HLA-A2+ healthy, non-smoker or smoker lung tissues and HLA-A2+ lung cancer cells lines [CRL-5865, CRL-5944 and NCI-H522]. Interferon-γ producing cells were quantitated using an Immunospot reader. Error bars represent SEM of experimental replicates (FIG. 1).

Figure 2:
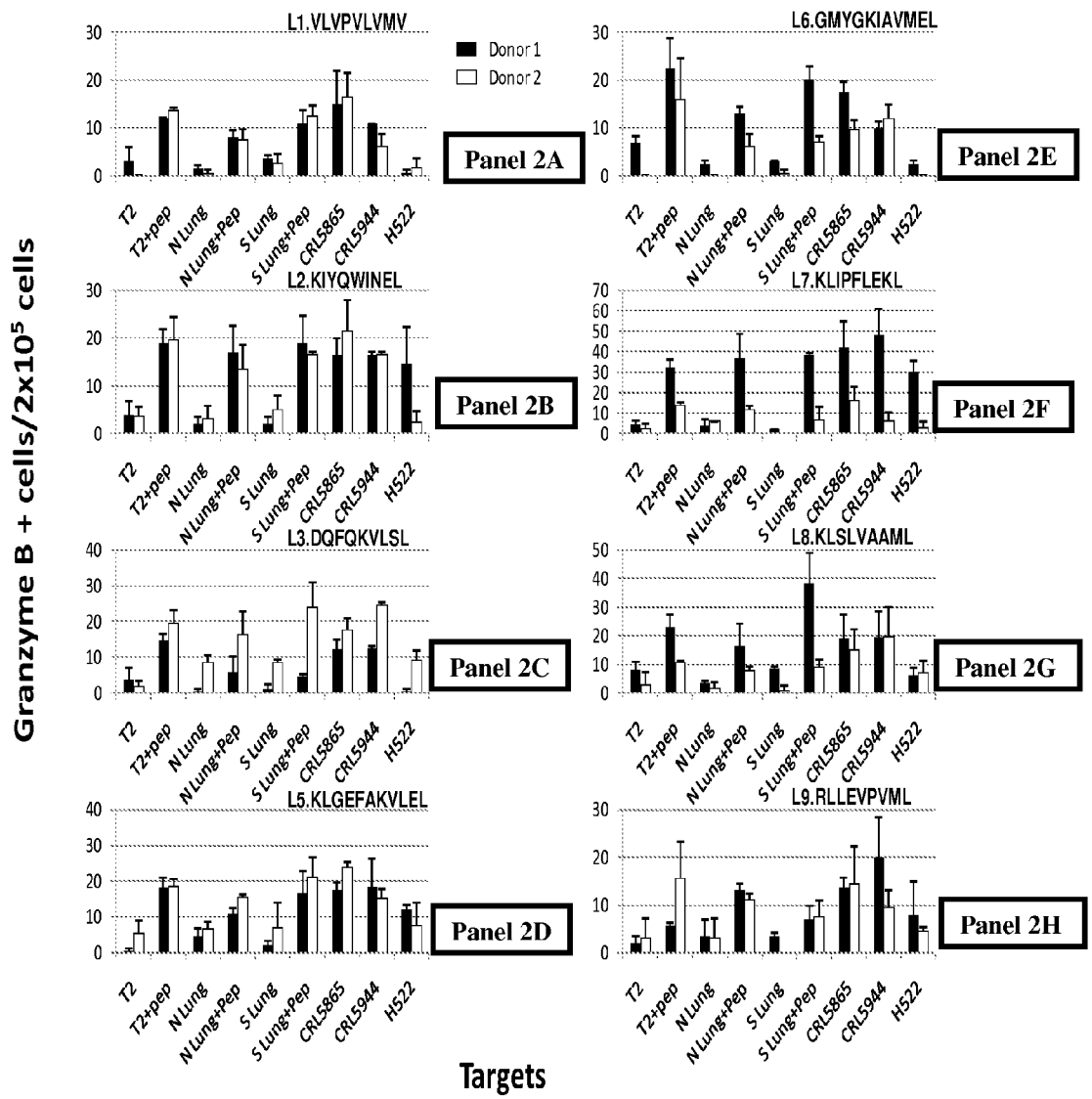
FIG. 2: Cytotoxic T cells generated against lung cancer epitopes are cytolytic: PBMC from two healthy HLA-A2+ donors were in vitro stimulated with synthetic peptides corresponding to each of the eight lung cancer epitopes (Panel A VLVPVLVMV; Panel B KIYQWINEL; Panel C DQFQKVLSL; Panel D KLGEFAKVLEL; Panel E GMYGKIAVMEL; Panel F KLIPFLEKL; Panel G KSLSVAAML; Panel H RLLEVPVML). These cells were tested in an ELISpot assay using T2 cells loaded with the corresponding synthetic peptide, normal cell suspensions obtained from HLA-A2+ healthy, non-smoker or smoker lung tissues and HLA-A2+ lung cancer cells lines [CRL-5865, CRL-5944 and NCI-H522]. Granzyme B producing cells were quantitated using an Immunospot reader. Error bars represent SEM of experimental replicates.

PBMC from two healthy HLA-A2+ donors were in vitro stimulated with synthetic peptides corresponding to each of the eight lung cancer epitopes. These cells were tested in an ELISpot assay using T2 cells loaded with the corresponding synthetic peptide, normal cell suspensions obtained from HLA-A2+ healthy, non-smoker or smoker lung tissues and HLA-A2+ lung cancer cells lines [CRL-5865, CRL-5944 and NCI-H522]. Granzyme B producing cells were quantitated using an Immunospot reader. Error bars represent SEM of experimental replicates (FIG. 2).

PBMC from a HLA-A2+ donor with lung cancer were in vitro stimulated with synthetic peptides corresponding to

TABLE 2

HLA class I presented lung cancer specific peptides selected for CTL characterization

| Epitopes | Protein | Function | Functional characterization |
|---|---|---|---|
| L1-VLVPVLVMV (SEQ ID NO: 82) | Discoidin, CUB and LCCL domain-containing protein 2 precursor | Increased in lung cancers during the process of tumor progression | Cell growth signaling |
| L2-KIYQWINEL (SEQ ID NO: 29) | Cell differentiation protein RCD1 homolog | Novel transcriptional cofactor that mediates retinoic acid-induced cell differentiation | Cell differentiation |
| L3-DQFQKVLSL (SEQ ID NO: 8) | ELP2_HUMAN Elongator complex protein 2 (ELP2) | Plays a role in chromatin remodeling and is involved in acetylation of histones H3 | Cell cycle |
| L4-KLGEFAKVLEL (SEQ ID NO: 33) | Serine/threonine-protein phosphatase 2A 65 kDa regulatory subunit A beta isoform | Involved in cell growth and signaling. Putative human tumor supressor gene, deregulated in multiple human cancers | Apoptosis regulation |
| L5-GMYGKIAVMEL (SEQ ID NO: 19) | DNA damage-binding protein 1 (DDB1) | Mediates oncogene-Induced $p16^{INK4a}$ activation; Maintains genome integrity through regulation of Cdt1 | DNA repair |
| L6-KLIPFLEKL (SEQ ID NO: 34) | CTD small phosphatase-like protein 2 (CTDSPL2, HSPC129) | Regulate the dynamic phosphorylation of RNA Polymerase II C-terminal domain (CTD), regulates RNAP II's activity during transcription initiation, elongation and RNA processing. Implicated as an in vitro breast cancer diagnostic marker | Transcriptional regulation |
| L7-KLSLVAAML (SEQ ID NO: 36) | Heat shock 70 kDa protein 5 (GRP78) | play an important role in hypoxia tolerance | Apoptosis |
| L8-RLLEVPVML (SEQ ID NO: 67) | ISOC2 HUMAN Isochorismatase domain-containing protein 2 | Inhibits the expression of $p16^{INK4a}$, suggesting a role during tumor development | Cell growth signaling | each of the three selected lung cancer epitopes (SEQ ID 82, SEQ ID 34 and SEQ ID 67). These cells were tested in an ELISpot assay using T2 cells loaded with the corresponding synthetic peptide, normal cell suspensions obtained from HLA-A2+ healthy, non-smoker or smoker lung tissues and HLA-A2+ lung cancer cells lines [CRL-5865, CRL-5944 and NCI-H522]. Interferon-γ producing cells were quantitated using an Immunospot reader. Error bars represent SEM of experimental replicates (FIG. 3A).

PBMC from a HLA-A2+ lung cancer patient were in vitro stimulated with synthetic peptides corresponding to each of the three selected lung cancer epitopes (SEQ ID 82, SEQ ID 34 and SEQ ID 67). These cells were tested in an ELISpot assay using T2 cells loaded with the corresponding synthetic peptide, normal cell suspensions obtained from HLA-A2+ healthy, non-smoker or smoker lung tissues and HLA-A2+ lung cancer cells lines [CRL-5865, CRL-5944 and NCI-H522]. Granzyme B producing cells were quantitated using an Immunospot reader. Error bars represent SEM of experimental replicates (FIG. 3B).

SUMMARY OF THE DATA

There is evidence in the literature that lung cancers express immunogenic proteins and these immune responses can be exploited to develop cancer vaccine strategies. However, the knowledge of which of these proteins are T cell targets are largely unknown. Immunotope has addressed this limitation by identifying peptides processed and presented through the MHC class I molecules of lung tumors where they may serve as targets of T cell responses.

In this project, we have identified a large number of peptides associated with MHC class I molecules on the lung cancer cells, CRL-5865 and CRL-5944. We selected 8 peptides based on their HLA-A2 motif and significance of the parent protein in cancer pathways for CTL characterization. These peptides, their protein sources and their functional significance are given in Table 1. Critical to the antigen selection process was that each antigen be derived from a parent protein that is a member of a pathway involved in maintaining the malignant phenotype (Hanahan, D., and R. A. Weinberg. (2000) The hallmarks of cancer. Cell 100:57-70). For several pathways represented, there are drugs also currently in development, thus the possibility for devising various agent/vaccine combination treatments.

Prior to utilizing these epitopes as part of a cancer vaccine development, we have performed studies to demonstrate that these peptides bind to (and stabilize) HLA-A2 molecules and that cytolytic T cells (CTL) could be generated to all peptides regardless of their affinity for the MHC Class I molecule in vitro and these CTL could recognize HLA-A2 expressing lung cancer cell lines, CRL5865 and CRL5944 (FIG. 1). Peptide-specific (L1-L8) CTLs were generated using healthy donor HLA-A2+ peripheral blood mononuclear cells. The T cells were restimulated with peptide and cytokines three times prior to assay for CTL activity. In vitro expanded T cells were used as effectors in ELISpot assays to assess antigen stimulated interferon-gamma (FIG. 1) or granzyme (FIG. 2) release using ELISpot assay kits. CTL activity was tested against peptide loaded T2 and lung tumor cells (CRL5865 and CRL5944). As a control, cells from a normal HLA-A2+ lung unpulsed or pulsed with synthetic peptides were used as targets.

CTL specific for the peptides recognized lung tumor lines suggesting that these peptide-specific CTL recognize endogenously presented epitopes. These peptide-specific CTLs were also tested against cells from HLA matched normal lung (FIG. 1-3: NLung) with no evidence of lysis, suggesting that these epitopes are not presented by normal lung cells and only presented by the MHC molecules on lung tumor cells. However, these CTLs lysed normal lung cells when they were pulsed with the appropriate peptides (FIG. 1-3: NLung+pep), indicating that the lack of endogenous processing and presentation of these peptides by normal tissue was the reason that the CTL did not lyse them. Overall, these studies indicate that these peptides are endogenously processed and presented in the context of MHC class I molecules on the tumor cells and not by normal cells and they are capable of activating a tumor-specific CTL response.

In addition to generating peptide specific CTLs from healthy PBMC, we also tested if lung cancer patients are capable of stimulating a T cell response to these peptides. As shown in FIGS. 3 and 4, indeed lung cancer patients' T cells are capable of responding to peptide specific activation and they generate lung cancer specific gamma-IFN (FIG. 3A) and granzyme (FIG. 3B) response against lung tumor cells and peptide loaded targets.

The data presented here demonstrate that the selected epitopes are naturally presented on the lung tumor cells and not on the HLA matched normal lung cells indicating these cancer associated proteins are processed through the MHC class I pathway in cancer cells. Furthermore, these epitopes can activate T cells from healthy and lung cancer patients PBMC. The peptides specific CTLs are capable of recognizing and cytolytic to lung tumor cells and not normal lung cells demonstrating tumor specific immune response. These epitopes and their parent proteins are novel and never been described before as lung cancer vaccine antigens.

TABLE 3

Description of Fragments, Parent Sequence Identification and Parent SwissProt Identification Number for Peptides 1-86

| SEQ ID NO: | SWISSPORT IDENTIFICATION NUMBER | ACTIVE FRAGMENT | PARENT PROTEIN NAME |
|---|---|---|---|
| SEQ ID NO: 1 | Q7Z460 | AEYDNFFQHL | CLIP-associating protein 1-*Homo sapiens* (Human)-[CLAP1_HUMAN] |
| SEQ ID NO: 2 | P61923 | ALILEPSLYTV | Coatomer subunit zeta-1-*Homo sapiens* (Human)-[COPZ1_HUMAN] |
| SEQ ID NO: 3 | Q13075 | ALLGLDAVQL | Baculoviral IAP repeat-containing protein 1-*Homo sapiens* (Human)-[BIRC1_HUMAN] |
| SEQ ID NO: 4 | Q6UXD5 | DDVPERGLI | Seizure 6-like protein 2 precursor-*Homo sapiens* (Human)-[SE6L2_HUMAN] |

TABLE 3-continued

Description of Fragments, Parent Sequence Identification and
Parent SwissProt Identification Number for Peptides 1-86

| SEQ ID NO: | SWISSPORT IDENTIFICATION NUMBER | ACTIVE FRAGMENT | PARENT PROTEIN NAME |
|---|---|---|---|
| SEQ ID NO: 5 | P05109 | DINTDGAVNF | Protein S100-A8-*Homo sapiens* (Human)-[S10A8_HUMAN] |
| SEQ ID NO: 6 | Q5TZA2 | DLDPEAVRGAL | Rootletin-*Homo sapiens* (Human)-[CROCC_HUMAN |
| SEQ ID NO: 7 | Q9UGL1 | DPFAFIHKI | Lysine-specific demethylase 5B-*Homo sapiens* (Human)-[JAD1B_HUMAN] |
| SEQ ID NO: 8 | Q6IA86 | DQFQKVLSL | ELP2_HUMAN Elongator complex protein 2 (ELP2) (STAT3-interacting protein) (StIP1) (SHINC-2) |
| SEQ ID NO: 9 | P79381 | DSPVGLAAYIL | HEYP_PIG RecName: Full = Epoxide hydrolase 1; AltName: Full = Microsomal epoxide hydrolase; AltName: Full = Epoxide hydratase |
| SEQ ID NO: 10 | O14525 | DVIVKTPCPVV | Astrotactin-1 precursor-*Homo sapiens* (Human)-[ASTN1_HUMAN] |
| SEQ ID NO: 11 | Q6NUJ1 | EAVRSNLTL | Proactivator polypeptide-like 1 precursor [Contains: Saposin A-like; Saposin B-Val-like; Saposin B-like; Saposin C-like; Saposin D-like]-*Homo sapiens* (Human)-[SAPL1_HUMAN] |
| SEQ ID NO: 12 | Q86YQ2 | EINTVSIQVK | LATH_HUMAN Latherin precursor (Breast cancer and salivary gland-expressed protein) |
| SEQ ID NO: 13 | Q9UHY8 | ELNEILEEI | Fasciculation and elongation protein zeta-2-*Homo sapiens* (Human)-[FEZ2_HUMAN] |
| SEQ ID NO: 14 | O75325 | EMLPNLEIL | Leucine-rich repeat neuronal protein 2 precursor-*Homo sapiens* (Human)-[LRRN2_HUMAN] |
| SEQ ID NO: 15 | Q09666 | EMNIKVPKI | Neuroblast differentiation-associated protein AHNAK-*Homo sapiens* (Human)-[AHNK_HUMAN] |
| SEQ ID NO: 16 | P32004 | EVEEGESVVLPC | Neural cell adhesion molecule L1 precursor-*Homo sapiens* (Human)-[L1CAM_HUMAN] |
| SEQ ID NO: 17 | Q96K83 | EVVNDLNTL | Zinc finger protein 521-*Homo sapiens* (Human)-[ZN521_HUMAN] |
| SEQ ID NO: 18 | P54819 | FLLDGFPRTV | KAD2_HUMAN RecName: Full = Adenylate kinase isoenzyme 2, mitochondrial; Short = AK 2, AltName: Full = ATP-AMP transphosphorylase 2gi|75062006|sp|Q5REI7.3|KAD2_PONAB Adenylate kinase isoenzyme 2, mitochondrial (AK 2) (ATP-AMP transphosphorylase 2) |
| SEQ ID NO: 19 | Q16531 | GMYGKIAVMEL | DNA damage-binding protein 1-*Homo sapiens* (Human)-[DDB1_HUMAN] |
| SEQ ID NO: 20 | Q5TCZ1.1 | HYVYIINV | SPD2A_HUMAN RecName: Full = SH3 and PX domain-containing protein 2A; AltName: Full = SH3 multiple domains protein 1; AltName: Full = Five SH3 domain-containing protein; AltName: Full = Adaptor protein TKS5 |
| SEQ ID NO: 21 | A6H8Y1 | ILDVIDDTI | Transcription factor TFIIIB component B" homolog-*Homo sapiens* (Human)-[BDP1_HUMAN] |
| SEQ ID NO: 22 | P10912 | ILTTSVPVYSL | Growth hormone receptor precursor-*Homo sapiens* (Human)-[GHR_HUMAN] |
| SEQ ID NO: 23 | Q0P6H9 | IMPVHLLML | Transmembrane protein 62-*Homo sapiens* (Human)-[TMM62_HUMAN] |
| SEQ ID NO: 24 | Q70CQ2 | KDNIPMLL | Ubiquitin carboxyl-terminal hydrolase 34-*Homo sapiens* (Human)-[UBP34_HUMAN] |
| SEQ ID NO: 25 | Q9NZJ7 | KIFKEEGLLGF | Mitochondrial carrier homolog 1-*Homo sapiens* (Human)-[MTCH1_HUMAN] |

TABLE 3-continued

Description of Fragments, Parent Sequence Identification and
Parent SwissProt Identification Number for Peptides 1-86

| SEQ ID NO: | SWISSPORT IDENTIFICATION NUMBER | ACTIVE FRAGMENT | PARENT PROTEIN NAME |
|---|---|---|---|
| SEQ ID NO: 26 | P52385 | KIKTLLNEL | Probable processing and transport protein-Human herpesvirus 7 (strain JI) (HHV-7) (Human T lymphotropic virus)-[PRTP_HHV7J] |
| SEQ ID NO: 27 | Q9HBX8 | KILMLQNNQ | Leucine-rich repeat-containing G-protein coupled receptor 6 precursor-Homo sapiens (Human)-[LGR6_HUMAN] |
| SEQ ID NO: 28 | Q5BJE1 | KINELNEEL | Uncharacterized protein C18orF34-Homo sapiens (Human)-[CR034_HUMAN] |
| SEQ ID NO: 29 | Q92600 | KIYQWINEL | Cell differentiation protein RCD1 homolog-Homo sapiens (Human)-[RCD1_HUMAN] |
| SEQ ID NO: 30 | Q92947 | KLADMLTEITL | Glutaryl-CoA dehydrogenase, mitochondrial precursor-Homo sapiens (Human)-[GCDH_HUMAN] |
| SEQ ID NO: 31 | Q9Y5Q8 | KLFDIRPIW | General transcription factor 3C polypeptide 5-Homo sapiens (Human)-[TF3C5_HUMAN] |
| SEQ ID NO: 32 | P51968 | KLFIGGLSF | Heterogeneous nuclear ribonucleoproteins A2/B1-Homo sapiens (Human)-[ROA2_HUMAN] |
| SEQ ID NO: 33 | P30153 | KLGEFAKVLEL | Serine/threonine-protein phosphatase 2A 65 kDa regulatory subunit A alpha isoform-Homo sapiens (Human)-[2AAA_HUMAN] |
| SEQ ID NO: 34 | Q05D32 | KLIPFLEKL | CTD small phosphatase-like protein 2-Homo sapiens (Human)-[CTSL2_HUMAN] |
| SEQ ID NO: 35 | P31327 | KLNEINEKI | Carbamoyl-phosphatase synthase [ammonia], mitochondrial precursor-Homo sapiens (Human)-[CPSM_HUMAN] |
| SEQ ID NO: 36 | Q5R4P0 | KLSLVAAML | 78 kDa glucose-regulated protein precursor-Homo sapiens (Human)-[GRP78_HUMAN] |
| SEQ ID NO: 37 | P47756 | KLTSTVMLW | CAPZB_HUMAN F-actin-capping protein subunit beta (CapZ beta) |
| SEQ ID NO: 38 | Q5RBD7 | KLYEFVHSF | DJB15_PONAB DnaJ homolog subfamily B member 15 |
| SEQ ID NO: 39 | Q8N4J0 | KLYPWIHQF | CI041_HUMAN UPF0586 protein C9orf41 |
| SEQ ID NO: 40 | Q14204 | KLYQEMFAW | Cytoplasmic dynein 1 heavy chain 1-Homo sapiens (Human)-[DYHC1_HUMAN] |
| SEQ ID NO: 41 | Q7Z4H8 | KMFSDEILL | KDEL motif-containing protein 2 precursor-Homo sapiens (Human)-[KDEL2_HUMAN] |
| SEQ ID NO: 42 | Q99729 | KMFVGGLSW | Heterogeneous nuclear ribonucleoprotein A/B-Homo sapiens (Human)-[ROAA_HUMAN] |
| SEQ ID NO: 43 | Q9NY93 | KSLLFVNTL | DDX56_HUMAN RecName: Full = Probable ATP-dependent RNA helicase DDX56; AltName: Full = DEAD box protein 56; AltName: Full = ATP-dependent 61 kDa nucleolar RNA helicase; AltName: Full = DEAD-box protein 21 |
| SEQ ID NO: 44 | Q9H579 | LTIKSIITL | Uncharacterized protein C20orf132-Homo sapiens (Human)-[CT132_HUMAN] |
| SEQ ID NO: 45 | P51797 | LTLLNPRMIV | Chloride channel protein 6-Homo sapiens (Human)-[CLCN6_HUMAN] |
| SEQ ID NO: 46 | Q9Y467 | LVEELSLQEA | Sal-like protein 2-Homo sapiens (Human)-[SALL2_HUMAN] |
| SEQ ID NO: 47 | Q695T7 | LVFQTCDI | S6A19_HUMAN Sodium-dependent neutral amino acid translator B(0) (System B(0) neutral amino acid transporter) (B(0)AT1) (Solute carrier family 6 member 19) |

TABLE 3-continued

Description of Fragments, Parent Sequence Identification and
Parent SwissProt Identification Number for Peptides 1-86

| SEQ ID NO: | SWISSPORT IDENTIFICATION NUMBER | ACTIVE FRAGMENT | PARENT PROTEIN NAME |
|---|---|---|---|
| SEQ ID NO: 48 | Q8NDA8 | LVMSNQKEVL | HEAT repeat-containing protein KIAA1833-Homo sapiens (Human)-[K1833_HUMAN] |
| SEQ ID NO: 49 | Q9NVA4 | LVSIVVAVPL | Transmembrane protein 34-Homo sapiens (Human)-[TMM34_HUMAN] |
| SEQ ID NO: 50 | O43909 | LWPDIGVPI | Exostosin-like 3-Homo sapiens (Human)-[EXTL3_HUMAN] |
| SEQ ID NO: 51 | Q8WZ69 | MDRVLLHV | CK040_HUMAN Putative uncharacterized protein C11orf40 (Ro/SSA1-related protein) |
| SEQ ID NO: 52 | Q92543 | MEAAMKGLVQE | Sorting nexin-19-Homo sapiens (Human)-[SNX19_HUMAN] |
| SEQ ID NO: 53 | P12956 | MGFKPLVL | ATP-dependent DNA helicase 2 subunit 1-Homo sapiens (Human)-[KU70_HUMAN] |
| SEQ ID NO: 54 | Q9H799 | MLDLHCDKI | Uncharacterized protein C5orf42-Homo sapiens (Human)-[CE042_HUMAN] |
| SEQ ID NO: 55 | Q9Y6L6 | MTYDGNNPVT | Solute carrier organic anion transporter family member 1B1-Homo sapiens (Human)-[SO1B1_HUMAN] |
| SEQ ID NO: 56 | Q9H5V7 | MVDNPLNQLS | Zinc finger protein Pegasus-Homo sapiens (Human)-[IKZF5-HUMAN] |
| SEQ ID NO: 57 | O75319 | NKDNDKLI | DUS11_HUMAN RecName: Full = RNA/RNP complex-1-interacting phosphatase; AltName: Full = Phosphatase that interacts with RNA/RNP complex 1; AltName: Full = Dual specificity protein phosphatase 11 |
| SEQ ID NO: 58 | Q99650 | NKEVEEERIAG | Oncostatin-M specific receptor subunit beta precursor-Homo sapiens (Human)-[OSMR_HUMAN] |
| SEQ ID NO: 59 | Q08AD1 | QALAQKGLYVT | Calmodulin-regulated spectrin-associated protein 1-like protein 1-Homo sapiens (Human)-[CA1L1_HUMAN] |
| SEQ ID NO: 60 | P50789 | QINAMNSDILE | Major capsid protein L1-Human papillomavirus type 23-[VL1_HPV23] |
| SEQ ID NO: 61 | O75381 | QINEQVEKL | Peroxisomal membrane protein PEX14-Homo sapiens (Human)-[PEX14_HUMAN] |
| SEQ ID NO: 62 | Q8IVF4 | QLDELNQKL | Dynein heavy chain 10, axonemal-Homo sapiens (Human)-[DYH10_HUMAN] |
| SEQ ID NO: 63 | Q9BUI4 | QVHKRGVVEYEA | RPC3_HUMAN RecName: Full = DNA-directed RNA polymerase III subunit RPC3; Short = RNA polymerase III subunit C3; AltName: Full = DNA-directed RNA polymerase III subunit C; AltName: Full = DNA-directed III 62 kDa polypeptide; AltName: Full = RPC62 |
| SEQ ID NO: 64 | Q8TC76 | RIIKWLYSI | Protein FAM110B-Homo sapiens (Human)-[F110B_HUMAN) |
| SEQ ID NO: 65 | Q91YB0 | RINTVSLKEA | Circadial locomoter output cycles protein kaput-Homo sapiens (Human)-[CLOCK_HUMAN] |
| SEQ ID NO: 66 | O60508 | RLFPLSGHLLL | Pre-mRNA-processing factor 17-Homo sapiens (Human)-[PRP17-HUMAN] |
| SEQ ID NO: 67 | Q96AB3 | RLLEVPVML | ISOC2_HUMAN Isochorismatase domain-containing protein 2, mitochondrial precursor |
| SEQ ID NO: 68 | Q15022 | SIMSIDKAVT | Polycomb protein SUZ12-Homo sapiens (Human)-[SUZ12_HUMAN] |
| SEQ ID NO: 69 | P60019 | SLDRYIKI | GPR34_HUMAN RecName: Full = Probable G-protein coupled receptor |

TABLE 3-continued

Description of Fragments, Parent Sequence Identification and
Parent SwissProt Identification Number for Peptides 1-86

| SEQ ID NO: | SWISSPORT IDENTIFICATION NUMBER | ACTIVE FRAGMENT | PARENT PROTEIN NAME |
|---|---|---|---|
| | | | 34gi\|52000690\|sp\|Q6XCF2.1\|GPR34_GORGO RecName: Full = Probable G-protein coupled receptor 34gi\|82592894\|sp\|Q3SAG9.1\|GPR34_PANPA RecName: Full = Probable G-protein coupled receptor 34gi\|12643337\|sp\|Q9UPC5\|GPR34_HUMAN Probable G-protein coupled receptor 34 |
| SEQ ID NO: 70 | Q9BVK6 | SLFAGGMLRV | Transmembrane emp24 domain-containing protein 9 precursor-Homo sapiens (Human)-[TMED9_HUMAN] |
| SEQ ID NO: 71 | Q9ULM0 | SLMQCWQL | Pleckstrin homology domain-containing family H member 1-Homo sapiens (Human)-[PKHH1_HUMAN] |
| SEQ ID NO: 72 | Q8N3G9 | SLVAKDNGSL | Transmembrane protein 130 precursor-Homo sapiens (Human)-[TM130_HUMAN] |
| SEQ ID NO: 73 | Q8IZF5 | SLVLRKLDHL | Probable G-protein coupled receptor 113 precursor-Homo sapiens (Human)-[GP113_HUMAN] |
| SEQ ID NO: 74 | Q5VT52 | SPALALPNLAN | Uncharacterized protein KIAA0460-Homo sapiens (Human)-[K0460_HUMAN] |
| SEQ ID NO: 75 | Q92959 | SSSGLISSLNEI | SO2A1_HUMAN Solute carrier organic anion transporter family member 2A1 (Solute carrier family 21 member 2) (Prostaglandin transporter) (PGT) |
| SEQ ID NO: 76 | Q5GLZ8 | TCFNLLDL | HERC4_HUMAN Probable E3 ubiquitin-protein ligase HERC4 (HECT domain and RCC1-like domain-containing protein 4) |
| SEQ ID NO: 77 | Q9NT68 | TLTVGTNGGLK | Teneurin-2-Homo sapiens (Human)-[TEN2_HUMAN] |
| SEQ ID NO: 78 | P16220 | TLVQLPNGQTV | cAMP response element-binding protein-Homo sapiens (Human)-[CREB1_HUMAN] |
| SEQ ID NO: 79 | Q5GLZ8 | TVFVLDDGTV | Probable E3 ubiquitin-protein ligase HERC4-Homo sapiens (Human)-[HERC4_HUMAN] |
| SEQ ID NO: 80 | Q8NF91 | TVMMGKKL | Nesprin-1-Homo sapiens (Human)-[SYNE1_HUMAN] |
| SEQ ID NO: 81 | Q8WTV0 | VLGAVMIVMV | Scavenger receptor class B member 1-Homo sapiens (Human)-[SCRB1_HUMAN] |
| SEQ ID NO: 82 | Q96PD2 | VLVPVLVMV | Discoidin, CUB and LCCL domain-containing protein 2 precursor-Homo sapiens (Human)-[DCBD2_HUMAN] |
| SEQ ID NO: 83 | P23470 | VMLPDNQSL | Receptor-type tyrosine-protein phosphatase gamma precursor-Homo sapiens (Human)-[PTPRG_HUMAN] |
| SEQ ID NO: 84 | Q9BYE9 | YINQSKAIDYEA | PCD24_HUMAN RecName: Full = Protocadherin-24; AltName: Full = Protocadherin LKC; Short = PC-LKC; Flags: Precursor |
| SEQ ID NO: 85 | O60885 | YLLRVVLKT | Bromodomain-containing protein 4-Homo sapiens (Human)-[BRD4_HUMAN] |
| SEQ ID NO: 86 | Q13813 | YVEFTRSLFVN | Spectrin alpha chain, brain-Homo sapiens (Human)-[SPTA2_HUMAN] |

TABLE 4

SEQ ID NO, Parent Protein Identification and SwissProt Identification Number for Peptides 87-172

| SEQ ID NO: | SWISSPROT IDENTIFICATION NUMBER | PROTEIN NAME |
|---|---|---|
| SEQ ID NO: 87 | Q7Z460 | CLIP-associating protein 1-Homo sapiens (Human)-[CLAP1_HUMAN] |
| SEQ ID NO: 88 | P61923 | Coatomer subunit zeta-1-Homo sapiens (Human)-[COPZ1_HUMAN] |
| SEQ ID NO: 89 | Q13075 | Baculoviral IAP repeat-containing protein 1-Homo sapiens (Human)-[SE6L2-HUMAN] |
| SEQ ID NO: 90 | Q6UXD5 | Seizure 6-like protein 2 precursor-Homo sapiens (Human)-[SE6L2_HUMAN] |
| SEQ ID NO: 91 | P05109 | Protein S100-A8-Homo sapiens (Human)-[S10A8_HUMAN] |
| SEQ ID NO: 92 | Q5TZA2 | Rootletin-Homo sapiens (Human)-[CROCC_HUMAN |
| SEQ ID NO: 93 | Q9UGL1 | Lysine-specific demethylase 5B-Homo sapiens (Human)-[JAD1B_HUMAN] |
| SEQ ID NO: 94 | Q6IA86 | ELP2_HUMAN Elongator complex protein 2 (ELP2) (STAT3-interacting protein) (StIP1) (SHINC-2) |
| SEQ ID NO: 95 | P79381 | HYEP_PIG RecName: Full = Epoxide hydrolase 1; AltName: Full = Microsomal epoxide hydrolase; AltName: Full = Epoxide hydratase |
| SEQ ID NO: 96 | O14525 | Astrotactin-1 precursor-Homo sapiens (Human)-[ASTN1_HUMAN] |
| SEQ ID NO: 97 | Q6NUJ1 | Proactivator polypeptide-like 1 precursor [Contains: Saposin A-like; Saposin B-Val-like; Saposin C-like; Saposin D-like]-Homo sapiens (Human)-[SAPL1_HUMAN] |
| SEQ ID NO: 98 | Q86YQ2 | LATH_HUMAN Latherin precursor (Breast cancer and salivary gland-expressed protein) |
| SEQ ID NO: 99 | Q9UHY8 | Fasciculation and elongation protein zeta-2-Homo sapiens (Human)-[FEZ2_HUMAN] |
| SEQ ID NO: 100 | O75325 | Leucine-rich repeat neuronal protein 2 precursor-Homo sapiens (Human)-[LRRN2_HUMAN] |
| SEQ ID NO: 101 | Q09666 | Neuroblast differentiation-associated protein AHNAK-Homo sapiens (Human)-[AHNK_HUMAN] |
| SEQ ID NO: 102 | P32004 | Neural cell adhesion molecule L1 precursor-Homo sapiens (Human)-[L1CAM_HUMAN] |
| SEQ ID NO: 103 | Q96K83 | Zinc finger protein 521-Homo sapiens (Human)-[ZN521_HUMAN] |
| SEQ ID NO: 104 | P54819 | KAD2_HUMAN RecName: Full = Adenylate kinase isoenzyme 2, mitochondrial; Short = AK 2; AltName: Full = ATP-AMP transphosphorylase 2gi|75062006|sp|Q5REI7.3|KAD2_PONAB Adenylate kinase isoenzyme 2, mitochondrial (AK 2) (ATP-AMP transphosphorylase 2) |
| SEQ ID NO: 105 | Q16531 | DNA damage-binding protein 1-Homo sapiens (Human)-[DDB1_HUMAN] |
| SEQ ID NO: 106 | Q5TCZ1.1 | SPD2A_HUMAN RecName: Full = SH3 and PX domain-containing protein 2A; AltName: Full = SH3 multiple domains protein 1; AltName: Full = Five SH3 domain-containing protein; AltName: Full = Adaptor protein TKS5 |
| SEQ ID NO: 107 | A6H8Y1 | Transcription factor TFIIIB component B" homolog-Homo sapiens (Human)-[BDP1_HUMAN] |
| SEQ ID NO: 108 | P10912 | Growth hormone receptor precursor-Homo sapiens (Human)-[GHR_HUMAN] |

TABLE 4-continued

SEQ ID NO, Parent Protein Identification and SwissProt Identification Number for Peptides 87-172

| SEQ ID NO: | SWISSPROT IDENTIFICATION NUMBER | PROTEIN NAME |
|---|---|---|
| SEQ ID NO: 109 | Q0P6H9 | Transmembrane protein 62-Homo sapiens (Human)-[TMM62_HUMAN] |
| SEQ ID NO: 110 | Q70CQ2 | Ubiquitin carboxyl-terminal hydrolase 34-Homo sapiens (Human)-[UBP34_HUMAN] |
| SEQ ID NO: 111 | Q9NZJ7 | Mitochondrial carrier homolog 1-Homo sapiens (Human)-[MTCH1_HUMAN] |
| SEQ ID NO: 112 | P52385 | Probable processing and transport protein-Human herpesvirus 7 (strain JI) (HHV-7) (Human T lymphotropic virus)-[PRTP_HHV7J] |
| SEQ ID NO: 113 | Q9HBX8 | Leucine-rich repeat-containing G-protein coupled receptor 6 precursor-Homo sapiens (Human)-[LGR6_HUMAN] |
| SEQ ID NO: 114 | Q5BJE1 | Uncharacterized protein C18orf34-Homo sapiens (Human)-[CR034_HUMAN] |
| SEQ ID NO: 115 | Q92600 | Cell differentiation protein RCD1 homolog-Homo sapiens (Human)-[RCD1_HUMAN] |
| SEQ ID NO: 116 | Q92947 | Glutaryl-CoA dehydrogenase, mitochondrial precursor-Homo sapiens (Human)-[GCDH_HUMAN] |
| SEQ ID NO: 117 | Q9Y5Q8 | General transcription factor 3C polypeptide 5-Homo sapiens (Human)-[TF3C5_HUMAN] |
| SEQ ID NO: 118 | P51968 | Heterogeneous nuclear ribonucleoproteins A2/B1-Homo sapiens (Human)-[ROA2_HUMAN] |
| SEQ ID NO: 119 | P30153 | Serine/threonine-protein phosphatase 2A 65 kDa regulatory subunit A alpha isoform-Homo sapiens (Human)-[2AAA_HUMAN] |
| SEQ ID NO: 120 | Q05D32 | CTD small phosphatase-like protein 2-Homo sapiens (Human)-[CTSL2_HUMAN] |
| SEQ ID NO: 121 | P31327 | Carbamoyl-phosphate synthase [ammonia], mitochondrial precursor-Homo sapiens (Human)-[CPSM_HUMAN] |
| SEQ ID NO: 122 | Q5R4P0 | 78 kDa glucose-regulated protein precursor-Homo sapiens (Human)-[GRP78_HUMAN] |
| SEQ ID NO: 123 | P47756 | CAPZB_HUMAN F-actin-capping protein subunit beta (CapZ beta) |
| SEQ ID NO: 124 | Q5RBD7 | DJB15_PONAB DnaJ homolog subfamily B member 15 |
| SEQ ID NO: 125 | Q8N4J0 | CI041_HUMAN UPF0586 protein C9orf41 |
| SEQ ID NO: 126 | Q14204 | Cytoplasmic dynein 1 heavy chain 1-Homo sapiens (Human)-[DYHC1_HUMAN] |
| SEQ ID NO: 127 | Q7Z4H8 | KDEL motif-containing protein 2 precursor-Homo sapiens (Human)-[KDEL2_HUMAN] |
| SEQ ID NO: 128 | Q99729 | Heterogeneous nuclear ribonucleoprotein A/B-Homo sapiens (Human)-[ROAA_HUMAN] |
| SEQ ID NO: 129 | Q9NY93 | DDX56_HUMAN RecName: Full = Probable ATP-dependent RNA helicase DDX56; AltName: Full = DEAD box protein 56; AltName: Full = ATP-dependent 61 kDa nucleolar RNA helicase; AltName: Full = DEAD-box protein 21 |
| SEQ ID NO: 130 | Q9H579 | Uncharacterized protein C20orf132-Homo sapiens (Human)-[CT132_HUMAN] |
| SEQ ID NO: 131 | P51797 | Chloride channel protein 6-Homo sapiens (Human)-[CLCN6_HUMAN] |

TABLE 4-continued

SEQ ID NO, Parent Protein Identification and SwissProt
Identification Number for Peptides 87-172

| SEQ ID NO: | SWISSPROT IDENTIFICATION NUMBER | PROTEIN NAME |
|---|---|---|
| SEQ ID NO: 132 | Q9Y467 | Sal-like protein 2-*Homo sapiens* (Human)-[SALL2_HUMAN] |
| SEQ ID NO: 133 | Q695T7 | S6A19_HUMAN Sodium-dependent neutral amino acid transporter B(0) (System B(0) neutral amino acid transporter) (B(0)AT1) (Solute carrier family 6 member 19) |
| SEQ ID NO: 134 | Q8NDA8 | HEAT repeat-containing protein KIAA1833-*Homo sapiens* (Human)-[K1833_HUMAN] |
| SEQ ID NO: 135 | Q9NVA4 | Transmembrane protein 34-*Homo sapiens* (Human)-[TMM34_HUMAN] |
| SEQ ID NO: 136 | O43909 | Exostosin-like 3-*Homo sapiens* (Human)-[EXTL3_HUMAN] |
| SEQ ID NO: 137 | Q8WZ69 | CK040_HUMAN Putative uncharacterized protein C11orf40 (Ro/SSA1-related protein) |
| SEQ ID NO: 138 | Q92543 | Sorting nexin-19-*Homo sapiens* (Human)-[SNX19_HUMAN] |
| SEQ ID NO: 139 | P12956 | ATP-dependent DNA helicase 2 subunit 1-*Homo sapiens* (Human)-[KU70_HUMAN] |
| SEQ ID NO: 140 | Q9H799 | Uncharacterized protein C5orf42-*Homo sapiens* (Human)-[CE042_HUMAN] |
| SEQ ID NO: 141 | Q9Y6L6 | Solute carrier organic anion transporter family member 1B1-*Homo sapiens* (Human)-[SO1B1_HUMAN] |
| SEQ ID NO: 142 | Q9H5V7 | Zinc finger protein Pegasus-*Homo sapiens* (Human)-[IKZF5_HUMAN] |
| SEQ ID NO: 143 | O75319 | DUS11_HUMAN RecName: Full = RNA/RNP complex-1-interacting phosphatase; AltName: Full = Phosphatase that interacts with RNA/RNP complex 1; AltName: Full = Dual specificity protein phosphatase 11 |
| SEQ ID NO: 144 | Q99650 | Oncostatin-M specific receptor subunit beta precursor-*Homo sapiens* (Human)-[OSMR_HUMAN] |
| SEQ ID NO: 145 | Q08AD1 | Calmodulin-regulated spectrin-associated protein 1-like protein 1-*Homo sapiens* (Human)-[CA1L1_HUMAN] |
| SEQ ID NO: 146 | P50789 | Major capsid protein L1-Human papillomavirus type 23-[VL1_HPV23] |
| SEQ ID NO: 147 | O75381 | Peroxisomal membrane protein PEX14-*Homo sapiens* (Human)-[PEX14_HUMAN] |
| SEQ ID NO: 148 | Q8IVF4 | Dynein heavy chain 10, axonemal-*Homo sapiens* (Human)-[DYH10_HUMAN] |
| SEQ ID NO: 149 | Q9BUI4 | RPC3_HUMAN RecName: Full = DNA-directed RNA polymerase III subunit RPC3; Short = RNA polymerase III subunit C3; AltName: Full = DNA-directed RNA polymerase III subunit C; AltName: Full = DNA-directed III 62 kDa polypeptide; AltName: Full = RPC62 |
| SEQ ID NO: 150 | Q8TC76 | Protein FAM110B-*Homo sapiens* (Human)-[F110B_HUMAN] |
| SEQ ID NO: 151 | Q91YB0 | Circadian locomoter output cycles protein kaput-*Homo sapiens* (Human)-[CLOCK_HUMAN} |
| SEQ ID NO: 152 | O60508 | Pre-mRNA-processing factor 17-*Homo sapiens* (Human)-[PRP17_HUMAN] |
| SEQ ID NO: 153 | Q96AB3 | ISOC2_HUMAN Isochorismatase domain-containing protein 2, mitochondrial precursor |
| SEQ ID NO: 154 | Q15022 | Polycomb protein SUZ12-*Homo sapiens* (Human)-[SUZ12_HUMAN] |

TABLE 4-continued

SEQ ID NO, Parent Protein Identification and SwissProt Identification Number for Peptides 87-172

| SEQ ID NO: | SWISSPROT IDENTIFICATION NUMBER | PROTEIN NAME |
|---|---|---|
| SEQ ID NO: 155 | P60019 | GPR34_PANTR RecName: Full = Probable G-protein coupled receptor 34gi\|52000690\|sp\|Q6XCF2.1\|GPR34_GORGO RecName: Full = Probable G-protein coupled receptor 34gi\|82592894\|sp\|Q3SAG9.1\|GPR34_PANPA RecName: Full = Probable G-protein coupled receptor 34gi\|12643337\|sp\|Q9UPC5\|GPR34_HUMAN Probable G-protein coupled receptor 34 |
| SEQ ID NO: 156 | Q9BVK6 | Transmembrane emp24 domain-containing protein 9 precursor-*Homo sapiens* (Human)-[TMED9_HUMAN] |
| SEQ ID NO: 157 | Q9ULM0 | Pleckstrin homology domain-containing family H member 1-*Homo sapiens* (Human)-[PKHH1_HUMAN] |
| SEQ ID NO: 158 | Q8N3G9 | Transmembrane protein 130 precursor-*Homo sapiens* (Human)-[TM130_HUMAN] |
| SEQ ID NO: 159 | Q8IZF5 | Probable G-protein coupled receptor 113 precursor-*Homo sapiens* (Human)-[GP113_HUMAN] |
| SEQ ID NO: 160 | Q5VT52 | Uncharacterized protein KIAA0460-*Homo sapiens* (Human)-[K0460_HUMAN] |
| SEQ ID NO: 161 | Q92959 | SO2A1_HUMAN Solute carrier organic anion transporter family member 2A1 (Solute carrier family 21 member 2) (Prostaglandin transporter) (PGT) |
| SEQ ID NO: 162 | Q5GLZ8 | HERC4_HUMAN Probable E3 ubiquitin-protein ligase HERC4 (HECT domain and RCC1-like domain-containing protein 4) |
| SEQ ID NO: 163 | Q9NT68 | Teneurin 2-*Homo sapiens* (Human)-[TEN2_HUMAN] |
| SEQ ID NO: 164 | P16220 | cAMP response element-binding protein-*Homo sapiens* (Human)-[CREB1_HUMAN] |
| SEQ ID NO: 165 | Q5GLZ8 | Probable E3 ubiquitin-protein ligase HERC4-*Homo sapiens* (Human)-[HERC4_HUMAN] |
| SEQ ID NO: 166 | Q8NF91 | Nesprin-1-*Homo sapiens* (Human)-[SYNE1_HUMAN] |
| SEQ ID NO: 167 | Q8WTV0 | Scavenger receptor class B member 1-*Homo sapiens* (Human)-[SCRB1_HUMAN] |
| SEQ ID NO: 168 | Q96PD2 | Discoidin, CUB and LCCL domain-containing protein 2 precursor-*Homo sapiens* (Human)-[DCBD2_HUMAN |
| SEQ ID NO: 169 | P23470 | Receptor-type tyrosine-protein phosphatase gamma precursor-*Homo sapiens* (Human)-[PTPRG_HUMAN] |
| SEQ ID NO: 170 | Q9BYE9 | PCD24_HUMAN RecName: Full = Protocadherin-24; AltName: Full = Protocadherin LKC; Short = PC-LKC; Flags: Precursor |
| SEQ ID NO: 171 | O60885 | Bromodomain-containing protein 4-*Homo sapiens* (Human)-[BRD4_HUMAN] |
| SEQ ID NO: 172 | Q13813 | Spectrin alpha chain, brain-*Homo sapiens* (Human)-[SPTA2_HUMAN] |

Although the present invention has been described with reference to specific embodiments, workers skilled in the art will recognize that many variations may be made therefrom, for example in the particular experimental conditions herein described, and it is to be understood and appreciated that the disclosures in accordance with the invention show only some preferred embodiments and objects and advantages of the invention without departing from the broader scope and spirit of the invention. It is to be understood and appreciated that these discoveries in accordance with this invention are only those which are illustrated of the many additional potential applications that may be envisioned by one of ordinary skill in the art, and thus not in any way intended to be limiting of the invention. Accordingly, other objects and advantages of the invention will be apparent to those skilled in the art from the detailed description together with the claims.

SEQUENCE LISTING (172 sequences)

SEQ ID NO: 1 - protein, 10 aa, Homo sapiens
AEYDNFFQHL

SEQ ID NO: 2 - protein, 11 aa, Homo sapiens
ALILEPSLYTV

SEQ ID NO: 3 - protein, 10 aa, Homo sapiens
ALLGLDAVQL

SEQ ID NO: 4 - protein, 9 aa, Homo sapiens
DDVPERGLI

SEQ ID NO: 5 - protein, 10 aa, Homo sapiens
DINTDGAVNF

SEQ ID NO: 6 - protein, 11 aa, Homo sapiens
DLDPEAVRGAL

SEQ ID NO: 7 - protein, 9 aa, Homo sapiens
DPFAFIHKI

SEQ ID NO: 8 - protein, 9 aa, Homo sapiens
DQFQKVLSL

SEQ ID NO: 9 - protein, 11 aa, Homo sapiens
DSPVGLAAYIL

SEQ ID NO: 10 - protein, 11 aa, Homo sapiens
DVIVKTPCPVV

SEQ ID NO: 11 - protein, 9 aa, Homo sapiens
EAVRSNLTL

SEQ ID NO: 12 - protein, 10 aa, Homo sapiens
EINTVSIQVK

SEQ ID NO: 13 - protein, 9 aa, Homo sapiens
ELNEILEEI

SEQ ID NO: 14 - protein, 9 aa, Homo sapiens
EMLPNLEIL

SEQ ID NO: 15 - protein, 9 aa, Homo sapiens
EMNIKVPKI

SEQ ID NO: 16 - protein, 12 aa, Homo sapiens
EVEEGESVVLPC

SEQ ID NO: 17 - protein, 9 aa, Homo sapiens
EVVNDLNTL

SEQ ID NO: 18 - protein, 10 aa, Homo sapiens
FLLDGFPRTV

SEQ ID NO: 19 - protein, 11 aa, Homo sapiens
GMYGKIAVMEL

SEQ ID NO: 20 - protein, 8 aa, Homo sapiens
HYVYIINV

SEQ ID NO: 21 - protein, 9 aa, Homo sapiens
ILDVIDDTI

SEQ ID NO: 22 - protein, 11 aa, Homo sapiens
ILTTSVPVYSL

SEQ ID NO: 23 - protein, 9 aa, Homo sapiens
IMPVHLLML

SEQ ID NO: 24 - protein, 8 aa, Homo sapiens
KDNIPMLL

SEQ ID NO: 25 - protein, 11 aa, Homo sapiens
KIFKEEGLLGF

SEQ ID NO: 26 - protein, 9 aa, herpes simplex virus 7
KIKTLLNEL

SEQ ID NO: 27 - protein, 9 aa, Homo sapiens
KILMLQNNQ

SEQ ID NO: 28 - protein, 9 aa, Homo sapiens
KINELNEEL

SEQ ID NO: 29 - protein, 9 aa, Homo sapiens
KIYQWINEL

SEQ ID NO: 30 - protein, 11 aa, Homo sapiens
KLADMLTEITL

SEQ ID NO: 31 - protein, 9 aa, Homo sapiens
KLFDIRPIW

SEQ ID NO: 32 - protein, 9 aa, Homo sapiens
KLFIGGLSF

SEQ ID NO: 33 - protein, 11 aa, Homo sapiens
KLGEFAKVLEL

SEQ ID NO: 34 - protein, 9 aa, Homo sapiens
KLIPFLEKL

SEQ ID NO: 35 - protein, 9 aa, Homo sapiens
KLNEINEKI

SEQ ID NO: 36 - protein, 9 aa, Homo sapiens
KLSLVAAML

SEQ ID NO: 37 - protein, 9 aa, Homo sapiens
KLTSTVMLW

SEQ ID NO: 38 - protein, 9 aa, Homo sapiens
KLYEFVHSF

SEQ ID NO: 39 - protein, 9 aa, Homo sapiens
KLYPWIHQF

SEQ ID NO: 40 - protein, 9 aa, Homo sapiens
KLYQEMFAW

SEQ ID NO: 41 - protein, 9 aa, Homo sapiens
KMFSDEILL

SEQ ID NO: 42 - protein, 9 aa, Homo sapiens
KMFVGGLSW

SEQ ID NO: 43 - protein, 9 aa, Homo sapiens
KSLLFVNTL

SEQ ID NO: 44 - protein, 9 aa, Homo sapiens
LTIKSIITL

SEQ ID NO: 45 - protein, 10 aa, Homo sapiens
LTLLNPRMIV

SEQ ID NO: 46 - protein, 10 aa, Homo sapiens
LVEELSLQEA

SEQ ID NO: 47 - protein, 8 aa, Homo sapiens
LVFQTCDI

SEQ ID NO: 48 - protein, 10 aa, Homo sapiens
LVMSNQKEVL

SEQ ID NO: 49 - protein, 10 aa, Homo sapiens
LVSIVVAVPL

SEQ ID NO: 50 - protein, 9 aa, Homo sapiens
LWPDIGVPI

SEQ ID NO: 51 - protein, 8 aa, Homo sapiens
MDRVLLHV

SEQ ID NO: 52 - protein, 11 aa, Homo sapiens
MEAAMKGLVQE

SEQ ID NO: 53 - protein, 8 aa, Homo sapiens
MGFKPLVL

SEQ ID NO: 54 - protein, 9 aa, Homo sapiens
MLDLHCDKI

SEQ ID NO: 55 - protein, 10 aa, Homo sapiens
MTYDGNNPVT

SEQ ID NO: 56 - protein, 10 aa, Homo sapiens
MVDNPLNQLS

SEQ ID NO: 57 - protein, 8 aa, Homo sapiens
NKDNDKLI

SEQ ID NO: 58 - protein, 11 aa, Homo sapiens
NKEVEEERIAG

SEQ ID NO: 59 - protein, 11 aa, Homo sapiens
QALAQKGLYVT

SEQ ID NO: 60 - protein, 11 aa, Human papillomavirus type 23
QINAMNSDILE

SEQ ID NO: 61 - protein, 9 aa, Homo sapiens
QINEQVEKL

SEQ ID NO: 62 - protein, 9 aa, Homo sapiens
QLDELNQKL

SEQ ID NO: 63 - protein, 12 aa, Homo sapiens
QVHKRGVVEYEA

SEQ ID NO: 64 - protein, 9 aa, Homo sapiens
RIIKWLYSI

SEQ ID NO: 65 - protein, 10 aa, Homo sapiens
RINTVSLKEA

SEQ ID NO: 66 - protein, 11 aa, Homo sapiens
RLFPLSGHLLL

SEQ ID NO: 67 - protein, 9 aa, Homo sapiens
RLLEVPVML

SEQ ID NO: 68 - protein, 10 aa, Homo sapiens
SIMSIDKAVT

SEQ ID NO: 69 - protein, 8 aa, Homo sapiens
SLDRYIKI

SEQ ID NO: 70 - protein, 10 aa, Homo sapiens
SLFAGGMLRV

SEQ ID NO: 71 - protein, 8 aa, Homo sapiens
SLMQCWQL

SEQ ID NO: 72 - protein, 10 aa, Homo sapiens
SLVAKDNGSL

SEQ ID NO: 73 - protein, 10 aa, Homo sapiens
SLVLRKLDHL

SEQ ID NO: 74 - protein, 11 aa, Homo sapiens
SPALALPNLAN

SEQ ID NO: 75 - protein, 12 aa, Homo sapiens
SSSGLISSLNEI

SEQ ID NO: 76 - protein, 8 aa, Homo sapiens
TCFNLLDL

SEQ ID NO: 77 - protein, 11 aa, Homo sapiens
TLTVGTNGGLK

SEQ ID NO: 78 - protein, 11 aa, Homo sapiens
TLVQLPNGQTV

SEQ ID NO: 79 - protein, 10 aa, Homo sapiens
TVFVLDDGTV

SEQ ID NO: 80 - protein, 8 aa, Homo sapiens
TVMMGKKL

SEQ ID NO: 81 - protein, 10 aa, Homo sapiens
VLGAVMIVMV

SEQ ID NO: 82 - protein, 9 aa, Homo sapiens
VLVPVLVMV

SEQ ID NO: 83 - protein, 9 aa, Homo sapiens
VMLPDNQSL

SEQ ID NO: 84 - protein, 12 aa, Homo sapiens
YINQSKAIDYEA

SEQ ID NO: 85 - protein, 9 aa, Homo sapiens
YLLRVVLKT

SEQ ID NO: 86 - protein, 11 aa, Homo sapiens
YVEFTRSLFVN

SEQ ID NO: 87 - protein, 1538 aa, Homo sapiens
MEPRMESCLAQVLQKDVGKRLQVGQELIDYFSDKQKSADLEHDQTMLDKLVDGLATSWVNSSNYKVVLLGMDILSALVTRLQDRFKAQIGTVLPSLIDRLGDAKDSVREQDQTLLLKIMDQAANPQYVWDRMLGGFKHKNFRTREGICLCLIATLNASGAQTLTLSKIVPHICNLLGDPNSQVRDAAINSLVEIYRHVGERVRADLSKKGLPQSRLNVIFTKFDEVQKSGNMIQSANDKNFDDEDSVDGNRPSSASSTSSKAPPSSRRNVGMGTTRRLGSSTLGSKSSAAKEGAGAVDEEDFIKAFDDVPVVQIYSSRDLEESINKIREILSDDKHDWEQRVNALKKIRSLLLAGAAEYDNFFQHLRLLDGAFKLSAKDLRSQVVREACITLGHLSSVLGNKFDHGAEAIMPTIFNLIPNSAKIMATSGVVAVRLIIRHTHIPRLIPVITSNCTSKSVAVRRRCFEFLDLLLQEWQTHSLERHISVLAETIKKGIHDADSEARIEARKCYWGFHSHFSREAEHLYHTLESSYQKALQSHLKNSDSIVSLPQSDRSSSSSQESLNRPLSAKRSPTGSTTSRASTVSTKSVSTTGSLQRSRSDIDVNAAASAKSKVSSSSGTTPFSSAAALPPGSYASLGRIRTRRQSSGSATNVASTPDNRGRSRAKVVSQSQRSRSANPAGAGSRSSSPGKLLGSGYGGLTGGSSRGPPVTPSSEKRSKIPRSQGCSRETSPNRIGLARSSRIPRPSMSQGCSRDTSRESSRDTSPARGFPPLDRFGLGQPGRIPGSVNAMRVLSTSTDLEAAVADALKKPVRRRYEPYGMYSDDDANSDASSVCSERSYGSRNGGIPHYLRQTEDVAEVLNHCASSNWSERKEGLLGLQNLLKSQRTLSRVELKRLCEIFTRMFADPHSKRVFSMFLETLVDFIIIHKDDLQDWLFVLLTQLLKKMGADLLGSVQAKVQKALDVTRDSFPFDQQFNILMRFIVDQTQTPNLKVKVAILKYIESLARQMDPTDFVNSSETRLAVSRIITWTTEPKSSDVRKAAQIVLISLFELNTPEFTMLLGALPKTFQDGATKLLHNHLKNSSNTSVGSPSNTIGRTPSRHTSSRTSPLTSPTNCSHGGLSPSRLWGWSADGLAKHPPPFSQPNSIPTAPSHKALRRSYSPSMLDYDTENLNSEEIYSSLRGVTEAIEKFSFRSQEDLNEPIKRDGKKECDIVSRDGGAASPATEGRGGSEVEGGRTALDNKTSLLNTQPPRAFPGPRARDYNPYPYSDAINTYDKTALKEAVFDDDMEQLRDVPIDHSDLVADLLKELSNHNERVEERKGALLELLKITREDSLGVWEEHFKTILLLLLETLGDKDHSIRALALRVLREILRNQPARFKNYAELTIMKTLEAHKDSHKEVVRAAEEAASTLASSIHPEQCIKVLCPIIQTADYPINLAAIKMQTKVVERIAKESLLQLLVDIIPGLLQGYDNTESSVRKASVFCLVAIYSVIGEDLKPHLAQLTGSKMKLLNLYIKRAQTTNSNSSSSSDVSTHS

SEQ ID NO: 88 - protein, 177 aa, Homo sapiens
MEALILEPSLYTVKAILILDNDGDRLFAKYYDDTYPSVKEQKAFEKNIFNKTHRTDSEIALLEGLTVVYKSSIDLYFYVIGSSYENELMLMAVLNCLFDSLSQMLRKNVEKRALLENMEGLFLAVDEIVDGGVILESDPQQVVHRVALRGEDVPLTEQTVSQVLQSAKEQIKWSLLR

SEQ ID NO: 89 - protein, 1403 aa, Homo sapiens
MATQQKASDERISQFDHNLLPELSALLGLDAVQLAKELEEEEQKERAKMQKGYNSQMRSEAKRLKTFVTYEPYSSWIPQEMAAAGFYFTGVKSGIQCFCCSLILFGAGLTRLPIEDHKRFHPDCGFLLNKDVGNIAKYDIRVKNLKSRLRGGKMRYQEEEARLASFRNWPFYVQGISPCVLSEAGFVFTGKQDTVQCFSCGGCLGNWEEGDDPWKEHAKWFPKCEFLRSKKSSEEITQYIQSYKGFVDITGEHFVNSWVQRELPMASAYCNDSIFAYEELRLDSFKDWPRESAVGVAALAKAGLFYTGIKDIVQCFSCGGCLEKWQEGDDPLDDHTRCFPNCPFLQNMKSSAEVTPDLQSRGELCELLETTSESNLEDSIAVGPIVPEMAQGEAQWFQEAKNLNEQLRAAYTSASFRHMSLLDISSDLATDHLLGCDLSIASKHISKPVQEPLVLPEVFGNLNSVMCVEGEAGSGKTVLLKKIAFLWASGCCPLLNRFQLVFYLSLSSTRPDEGLASIICDQLLEKEGSVTEMCVRNIIQQLKNQVLFLLDDYKEICSIPQVIGKLIQKNHLSRTCLLIAVRTNRARDIRRYLETILEIKAFPFYNTVCILRKLFSHNMTRLRKFMVYFGKNQSLQKIQKTPLFVAAICAHWFQYPFDPSFDDVAVFKSYMERLSLRNKATAEILKATVSSCGELALKGFFSCCFEFNDDDLAEAGVDEDEDLTMCLMSKFTAQRLRPFYRFLSPAFQEFLAGMRLIELLDSDRQEHQDLGLYHLKQINSPMMTVSAYNNFLNYVSSLPSTKAGPKIVSHLLHLVDNKESLENISENDDYLKHQPEISLQMQLLRGLWQICPQAYFSMVSEHLLVLALKTAYQSNTVAACSPFVLQFLQGRTLTLGALNLQYFFDHPESLSLLRSIHFPIRGNKTSPRAHFSVLETCFDKSQVPTIDQDYASAFEPMNEWERNLAEKEDNVKSYMDMQRRASPDLSTGYWKLSPKQYKIPCLEVDVNDIDVVGQDMLEILMTVFSASQRIELHLNHSRGFIESIRPALELSKASVTKCSISKLELSAAEQELLLTLPSLESLEVSGTIQSQDQIFPNLDKFLCLKELSVDLEGNINVFSVIPEEFPNFHHMEKLLIQISAEYDPSKLVKLIQNSPNLHVFHLKCNFFSDFGSLMTMLVSCKKLTEIKFSDSFFQAVPFVASLPNFISLKILNLEGQQFPDEETSEKFAYILGSLSNLEELILPTGDGIYRVAKLIIQQCQQLHCLRVLSFFKTLNDDSVVEIAKVAISGGFQKLENLKLSINHKITEEGYRNFFQALDNMPNLQELDISRHFTECIKAQATTVKSLSQCVLRLPRLIRLNMLSWLLDADDIALLNVMKERHPQSKYLTILQKWILPFSPIIQK

SEQ ID NO: 90 - protein, 910 aa, Homo sapiens
MGTPRAQHPPPPQLLFLILLSCPWIQGLPLKEEEILPEPGSETPTVASEALAELLHGALLRRGPEMGYLPGSDPDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVTQTTDPSRQLEGGNLALAILLPLGLVIVLGSGVYIYYTKLQGKSLFGFSGSHSYSPITVESDFSNPLYEAGDTREYEVSI

SEQ ID NO: 91 - protein, 93 aa, Homo sapiens
MLTELEKALNSIIDVYHKYSLIKGNFHAVYRDDLKKLLETECPQYIRKKGADVWFKELDINTDGAVNFQEFLILVIKMGVAAHKKSHEESHKE

SEQ ID NO: 92 - protein, 2017 aa, Homo sapiens
MSLGLARAQEVELTLETVIQTLESSVLCQEKGLGARDLAQDAQITSLPALIREIVTRNLSQPESPVLLPATEMASLLSLQEENQLLQQELSRVEDLLAQSRAERDELAIKYNAVSERLEQALRLEPGELETQEPRGLVRQSVELRRQLQEEQASYRRKLQAYQEGQQRQAQLVQRLQGKILQYKKRCSELEQQLLERSGELEQQRLRDTEHSQDLESALIRLEEEQQRSASLAQVNAMLREQLDQAGSANQALSEDIRKVTNDWTRCRKELEHREAAWRREEESFNAYFSNEHSRLLLLWRQVVGFRRLVSEVKMFTERDLLQLGGELARTSRAVQEAGLGLSTGLRLAESRAEAALEKQALLQAQLEEQLRDKVLREKDLAQQQMQSDLDKADLSARVTELGLAVKRLEKQNLEKDQVNKDLTEKLEALESLRLQEQAALETEDGEGLQQTLRDLAQAVLSDSESGVQLSGSERTADASNGSLRGLSGQRTPSPPRRSSPGRGRSPRRGPSPACSDSSTLALIHSALHKRQLQVQDMRGRYEASQDLLGTLRKQLSDSESERRALEEQLQRLRDKTDGAMQAHEDAQREVQRLRSANELLSREKSNLAHSLQVAQQQAEELRQEREKLQAAQEELRRQRDRLEEEQEDAVQDGARVRRELERSHRQLEQLEGKRSVLAKELVEVREALSRATLQRDMLQAEKAEVAEALTKAEAGRVELELSMTKLRAEEASLQDSLSKLSALNESLAQDKLDLNRLVAQLEEEKSALQGRQRQAEQEATVAREEQERLEELRLEQEVARQGLEGSLRVAEQAQEALEQQLPTLRHERSQLQEQLAQLSRQLSGREQELEQARREAQRQVEALERAAREKEALAKEHAGLAVQLVAAEREGRTLSEEATRLRLEKEALEGSLFEVQRQLAQLEARREQLEAEGQALLLAKETLTGELAGLRQQIIATQEKASLDKELMAQKLVQAEREAQASLREQRAAHEEDLQRLQREKEAAWRELEAERAQLQSQLQREQEELLARLEAEKEELSEEIAALQQERDEGLLLAESEKQQALSLKESEKTALSEKLMGTRHSLATISLEMERQKRDAQSRQEQDRSTVNALTSELRDLRAQREEAAAAHAQEVRRLQEQARDLGKQRDSCLREAEELRTQLRLLEDARDGLRRELLEAQRKLRESQEGREVQRQEAGELRRSLGEGAKEREALRRSNEELRSAVKKAESERISLKLANEDKEQKLALLEEARTAVGKEAGELRTGLQEVERSRLEARRELQELRRQMKMLDSENTRLGRELAELQGRLALGERAEKESRRETLGLRQRLLKGEASLEVMRQELQVAQRKLQEQEGEFRTRERRLLGSLEEARGTEKQQLDHARGLELKLEAARAEAAELGLRLSAAEGRAQGLEAELARVEVQRRAAEAQLGGLRSALRRGLGLGRAPSPAPRPVPGSPARDAPAEGSGEGLNSPSTLECSPGSQPPSPGPATSPASPDLDPEAVRGALREFLQELRSAQRERDELRTQTSALNRQLAEMEAERDSATSRARQLQKAVAESEEARRSVDGRLSGVQAELALQEESVRRSERERRATLDQVATLERSLQATESELRASQEKISKMKANETKLEGDKRRLKEVLDASESRTVKLELQRRSLEGELQRSRLGLSDREAQAQALQDRVDSLQRQVADSEVKAGTLQLTVERLNGALAKVEESEGALRDKVRGLTEALAQSSASLNSTRDKNLHLQKALTACEHDRQVLQERLDAARQALSEARKQSSSLGEQVQTLRGEVADLELQRVEAEGQLQQLREVLRQRQEGEAAALNTVQKLQDERRLLQERLGSLQRALAQLEAEKREVERSALRLEKDRVALRRTLDKVEREKLRSHEDTVRLSAEKGRLDRTLTGAELELAEAQRQIQQLEAQVVVLEQSHSPAQLEVDAQQQQLELQQEVERLRSAQAQTERTLEARERAHRQRVRGLEEQVSTLKGQLQQELRRSSAPFSPPSGPPEK

SEQ ID NO: 93 - protein, 1544 aa, Homo sapiens
MEAATTLHPGPRPALPLGGPGPLGEFLPPPECPVFEPSWEEFADPFAFIHKIRPIAEQTGICKVRPPPDWQPPFACDVDKLHFTPRIQRLNELEAQTRVKLNFLDQIAKYWELQGSTLKIPHVERKILDLFQLNKLVAEEGGFAVVCKDRKWTKIATKMGFAPGKAVGSHIRGHYERILNPYNLFLSGDSLRCLQKPNLTTDTKDKEYKPHDIPQRQSVQPSETCPPARRAKRMRAEAMNIKIEPEETTEARTHNLRRRMGCPTPKCENEKEMKSSIKQEPIERKDYIVENEKEKPKSRSKKATNAVDLYVCLLCGSGNDEDRLLLCDGCDDSYHTFCLIPPLHDVPKGDWRCPKCLAQECSKPQEAFGFEQAARDYTLRTFGEMADAFKSDYFNMPVHMVPTELVEKEFWRLVSTIEEDVTVEYGADIASKEFGSGFPVRDGKIKLSPEEEEYLDSGWNLNNMPVMEQSVLAHITADICGMKLPWLYVGMCFSSFCWHIEDHWSYSINYLHWGEPKTWYGVPGYAAEQLENVMKKLAPELFVSQPDLLHQLVTIMNPNTLMTHEVPVYRTNQCAGEFVITFPRAYHSGFNQGFNFAEAVNFCTVDWLPLGRQCVEHYRLLHRYCVFSHDEMICKMASKADVLDVVVASTVQKDMAIMIEDEKALRETVRKLGVIDSERMDFELLPDDERQCVKCKTTCFMSAISCSCKPGLLVCLHHVKELCSCPPYKYKLRYRYTLDDLYPMMNALKLRAESYNEWALNVNEALEAKITKKKSLVSFKALIEESEMKKFPDNDLLRHLRLVTQDAEKCASVAQQLLNGKRQTRYRSGGGKSQNQLTVNELRQFVTQLYALPCVLSQTPLLKDLLNRVEDFQQHSQKLLSEETPSAAELQDLLDVSFEFDVELPQLAEMRIRLEQARWLEEVQQACLDPSSLTLDDMRRLIDLGVGLAPYSAVEKAMARLQELLTVSEHWDDKAKSLLKARPRHSLNSLATAVKEIEEIPAYLPNGAALKDSVQRARDWLQDVEGLQAGGRVPVLDTLIELVTRGRSIPVHLNSLPRLETLVAEVQAWKECAVNTFLTENSPYSLLEVLCPRCDIGLLGLKRKQRKLKEPLPNGKKKSTKLESLSDLERALTESKETASAMATLGEARLREMEALQSLRLANEGKLLSPLQDVDIKICLCQKAPAAPMIQCELCRDAFHTSCVAVPSISQGLRIWLCPHCRRSEKPPLEKILPLLASLQRIRVRLPEGDALRYMIERTVNWQHRAQQLLSSGNLKFVQDRVGSGLLYSRWQASAGQVSDTNKVSQPPGTTSFSLPDDWDNRTSYLHSPFSTGRSCIPLHGVSPEVNELLMEAQLLQVSLPEIQELYQTLLAKPSPAQQTDRSSPVRPSSEKNDCCRGKRDGINSLERKLKRRLEREGLSSERWERVKKMRTPKKKKIKLSHPKDMNNFKLERERSYELVRSAETHSLPSDTSYSEQEDSEDEDAICPAVSCLQPEGDEVDWVQCDGSCNQWFHQVCVGVSPEMAEKEDYICVRCTVKDAPSRK

SEQ ID NO: 94 - protein, 826 aa, Homo sapiens
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVMCLQTLNFGNGFALALCLSFLPNTDVPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQVRVGEVGGNTLGFYDCQFNEDGSMIIAHAFHGALHLWKQNTVNPREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 95 - protein, 454 aa, Homo sapiens
MWLEILLASVLGFVIYWFVSKDKEETLLLGDGWWGPGSRPAAAEDESIRPFKVETSDEEINDLHQRIEKFRLTPPLEDSRFHYGFNSNYLKKIISYWRNTFDWRKQVEVLNKYPHFKTKIEGLDIHFIHVKPPQLPSGRTAKPLLMVHGWPGCFYEFYKIIPLLTDPKNHGLSDEHVFEVICPSIPGYGFSEASSKKGFNSVAAARIFYKLMLRLGFQEFYLQGGDWGSLICTNMAQLVPSHVKGLHLNVALVLRNVYTLTFFLGRRLGRLFGYTERDLELLYPFKKTFYTLMRESGYMHIQSTKPDTVGCALNDSPVGLAAYILEKFSTWTNEEFRDLEDGGLERKFSLDELLTVIMLYWTTGTITSSQRFYKENLGQGVMANKHEAIKVHVPTGFAAFPSEVLHCPEKWVKNKYPKLISYSYMARGGHFAAFEEPELLAQDIRKFMGLLEQQ

SEQ ID NO: 96 - protein, 1302 aa, Homo sapiens
MALAGLCALLACCWGPAAVLATAAGDVDPSKELECKLKSITVSALPFLRENDLSIMHSPSASEPKLLFSVRNDFPGEMVVVDDLENTELPYFVLEISGNTEDIPLVRWRQQWLENGTLLFHIHHQDGAPSLPGQDPTEEPQHESAEEELRILHISVMGGMIALLLSILCLVMILYTRRRWCKRRRVPQPQKSASAEAANEIHYIPSVLIGGHGRESLRNARVQGHNSSGTLSIRETPILDGYEYDITDLRHHLQRECMNGGEDFASQVTRTLDSLQGCNEKSGMDLTPGSDNAKLSLMNKYKDNIIATSPVDSNHQQATLLSHTSSSQRKRINNKARAGSAFLNPEGDSGTEAENDPQLTFYTDPSRSRRRSRVGSPRSPVNKTTLTLISITSCVIGLVCSSHVNCPLVVKITLHVPEHLIADGSRFILLEGSQLDASDWLNPAQVVLFSQQNSSGPWAMDLCARRLLDPCEHQCDPETGRREHRAAGECLCYEGYMKDPVHKHLCIRNEWGTNQGPWPYTIFQRGFDLVLGEQPSDKIFRFTYTLGEGMWLPLSKSFVIPPAELAINPSAKCKTDMTVMEDAVEVREELMTSSSFDSLEVLLDSFGPVRDCSKDNGGCSKNFRCISDRKLDSTGCVCPSGLSPMKDSSGCYDRHIGVDCSDGFNGGCEQLCLQQMAPFPDDPTLYNILMFCGCIEDYKLGVDGRSCQLITETCPEGSDCGESRELPMNQTLFGEMFFGYNNHSKEVAAGQVLKGTFRQNNFARGLDQQLPDGLVVATVPLENQCLEEISEPTPDPDFLTGMVNFSEVSGYPVLQHWKVRSVMYHIKLNQVAISQALSNALHSLDGATSRADFVALLDQFGNHYIQEAIYGFEESCSIWYPNKQVQRRLWLEYEDISKGNSPSDESEERERDPKVLTFPEYITSLSDSGTKHMAAGVRMECHSKGRCPSSCPLCHVTSSPDTPAEPVLLEVTKAAPIYELVTNNQTQRLLQEATMSSLWCSGTGDVIEDWCRCDSTAFGADGLPTCAPLPQPVLRLSTVHEPSSTLVVLEWEHSEPPIGVQIVDYLLRQEKVTDRMDHSKVETETVLSFVDDIISGAKSPCAMPSQVPDKQLTTISLIIRCLEPDTIYMFTLWGVDNTGRRSRPSDVIVKTPCPVVDDVKAQEIADKIYNLFNGYTSGKEQQTAYNTLLDLGSPTLHRVLYHYNQHYESFGEFTWRCEDELGPRKAGLILSQLGDLSSWCNGLLQEPKISLRRSSLKYLGCRYSEIKPYGLDWAELSRDLRKTCEEQTLSIPYNDYGDSKEI

SEQ ID NO: 97 - protein, 521 aa, Homo sapiens
MLCALLLLPSLLGATRASPTSGPQECAKGSTVWCQDLQTAARCGAVGYCQGAVWNKPTAKSLPCDVCQDIAAAAGNGLNPDATESDILALVMKTCEWLPSQESSAGCKWMVDAHSSAILSMLRGAPDSAPAQVCTALSLCEPLQRHLATLRPLSKEDTFEAVAPFMANGPLTFHPRQAPEGALCQDCVRQVSRLQEAVRSNLTLADLNIQEQCESLGPGLAVLCKNYLFQFFVPADQALRLLPPQELCRKGGFCEELGAPARLTQVVAMDGVPSLELGLPRKQSEMQMKAGVTCEVCMNVVQKLDHWLMSNSSELMITHALERVCSVMPASITKECIILVDTYSPSLVQLVAKITPEKVCKFIRLCGNRRRARAVHDAYAIVPSPEWDAENQGSFCNGCKRLLTVSSHNLESKSTKRDILVAFKGGCSILPLPYMIQCKHFVTQYEPVLIESLKDMMDPVAVCKKVGACHGPRTPLLGTDQCALGPSFWCRSQEAAKLCNAVQHCQKHVWKEMHLHAGEHA

SEQ ID NO: 98 - protein, 179 aa, Homo sapiens
MLNVSGLFVLLCGLLVSSSAQEVLAGVSSQLLNDLTQGLLRADFLPSLQTTGLQKPLSSAFDGVSGLLDIFGPPLTNEINTVSIQVKNPQLLHVSIESTPQRKEATVQVPFTSELIVQLLTMKPFTANMQSDIKVQIRLEKNVGGRYELAFGNCRLLPEAIWIQTGVQLAPAQNLLWQT

SEQ ID NO: 99 - protein, 353 aa, Homo sapiens
MAADGDWQDFYEFQEPARSLLDQENCNASPEPGAEAGAEAGGGADGFPAPACSLEEKLSLCFRPSDPGAEPPRTAVRPITERSLLQGDEIWNALTDNYGNVMPVDWKSSHTRTLHLLTLNLSEKGVSDSLLFDTSDDEELREQLDMHSIIVSCVNDEPLFTADQVIEEIEEMMQESPDPEDDETPTQSDRLSMLSQEIQTLKRSSTGSYEERVKRLSVSELNEILEEIETAIKEYSEELVQQLALRDELEFEKEVKNSFISVLIEVQNKQKEHKETAKKKKKLKNGSSQNGKNERSHMPGTYLTTVIPYEKKNGPPSVEDLQILTKILRAMKEDSEKVPSLLTDYILKVLCPT

SEQ ID NO: 100 - protein, 713 aa, Homo sapiens
MRLLVAPLLLAWVAGATAAVPVVPWHVPCPPQCACQIRPWYTPRSSYREATTVDCNDLFLTAVPPALPAGTQTLLLQSNSIVRVDQSELGYLANLTELDLSQNSFSDARDCDFHALPQLLSLHLEENQLTRLEDHSFAGLASLQELYLNHNQLYRIAPRAFSGLSNLLRLHLNSNLLRAIDSRWFEMLPNLEILMIGGNKVDAILDMNFRPLANLRSLVLAGMNLREISDYALEGLQSLESLSFYDNQLARVPRRALEQVPGLKFLDLNKNPLQRVGPGDFANMLHLKELGLNNMEELVSIDKFALVNLPELTKLDITNNPRLSFIHPRAFHHLPQMETLMLNNNALSALHQQTVESLPNLQEVGLHGNPIRCDCVIRWANATGTRVRFIEPQSTLCAEPPDLQRLPVREVPFREMTDHCLPLISPRSFPPSLQVASGESMVLHCRALAEPEPEIYWVTPAGLRLTPAHAGRRYRVYPEGTLELRRVTAEEAGLYTCVAQNLVGADTKTVSVVVGRALLQPGRDEGQGLELRVQETHPYHILLSWVTPPNTVSTNLTWSSASSLRGQGATALARLPRGTHSYNITRLLQATEYWACLQVAFADAHTQLACVWARTKEATSCHRALGDRPGLIAILALAVLLLAAGLAAHLGTGQPRKGVGGRRPLPPAWAFWGWSAPSVRVVSAPLVLPWNPGRKLPRSSEGETLLPPLSQNS

SEQ ID NO: 101 - protein, 5890 aa, Homo sapiens
MEKEETTRELLLPNWQGSGSHGLTIAQRDDGVFVQEVTQNSPAARTGVVKEGDQIVGATIYFDNLQSGEVTQLLNTMGHHTVGLKLHRKGDRSPEPGQTWTREVFSSCSSEVVLSGDDEEYQRIYTTKIKPRLKSEDGVEGDLGETQSRTITVTRRVTAYTVDVTGREGAKDIDISSPEFKIKIPRHELTEISNVDVETQSGKTVIRLPSGSGAASPTGSAVDIRAGAISASGPELQGAGHSKLQVTMPGIKVGGSGVNVNAKGLDLGGRGGVQVPAVDISSSLGGRAVEVQGPSLESGDHGKIKFPTMKVPKFGVSTGREGQTPKAGLRVSAPEVSVGHKGGKPGLTIQAPQLEVSVPSANIEGLEGKLKGPQITGPSLEGDLGLKGAKPQGHIGVDASAPQIGGSITGPSVEVQAPDIDVQGPGSKLNVPKMKVPKFSVSGAKGEETGIDVTLPTGEVTVPGVSGDVSLPEIATGGLEGKMKGTKVKTPEMIIQKPKISMQDVDLSLGSPKLKGDIKVSAPGVQGDVKGPQVALKGSRVDIETPNLEGTLTGPRLGSPSGKTGTCRISMSEVDLNVAAPKVKGGVDVTLPRVEGKVKVPEVDVRGPKVDVSAPDVEAHGPEWNLKMPKMKMPTFSTPGAKGEGPDVHMTLPKGDISISGPKVNVEAPDVNLEGLGGKLKGPDVKLPDMSVKTPKISMPDVDLHVKGTKVKGEYDVTVPKLEGELKGPKVDIDAPDVDVHGPDWHLKMPKMKMPKFSVPGFKAEGPEVDVNLPKADVDISGPKIDVTAPDVSIEEPEGKLKGPKFKMPEMNIKVPKISMPDVDLHLKGPNVKGEYDVTMPKVESEIKVPDVELKSAKMDIDVPDVEVQGPDWHLKMPKMKMPKFSMPGFKAEGPEVDVNLPKADVDISGPKVGVEVPDVNIEGPEGKLKGPKFKMPEMNIKAPKISMPDVDLHMKGPKVKGEYDMTVPKLEGDLKGPKVDVSAPDVEMQGPDWNLKMPKIKMPKFSMPSLKGEGPEFDVNLSKANVDISAPKVDTNAPDLSLEGPEGKLKGPKFKMPEMHFRAPKMSLPDVDLDLKGPKMKGNVDISAPKIEGEMQVPDVDIRGPKVDIKAPDVEGQGLDWSLKIPKMKMPKFSMPSLKGEGPEVDVNLPKADVVVSGPKVDIEAPDVSLEGPEGKLKGPKFKMPEMHFKTPKISMPDVDLHLKGPKVKGDVDVSVPKVEGEMKVPDVEIKGPKMDIDAPDVEVQGPDWHLKMPKMKMPKFSMPGFKGEGREVDVNLPKADIDVSGPKVDVEVPDVSLEGPEGKLKGPKFKMPEMHFKAPKISMPDVDLNLKGPKLKGDVDVSLPEVEGEMKVPDVDIKGPKVDISAPDVDVHGPDWHLKMPKVKMPKFSMPGFKGEGPEVDVKLPKADVDVSGPKMDAEVPDVNIEGPDAKLKGPKFKMPEMSIKPQKISIPDVGLHLKGPKMKGDYDVTVPKVEGEIKAPDVDIKGPKVDINAPDVEVHGPDWHLKMPKVKMPKFSMPGFKGEGPEVDMNLPKADLGVSGPKVDIDVPDVNLEAPEGKLKGPKFKMPSMNIQTHKISMPDVGLNLKAPKLKTDVDVSLPKVEGDLKGPEIDVKAPKMDVNVGDIDIEGPEGKLKGPKFKMPEMHFKAPKISMPDVDLHLKGPKVKGDMDVSVPKVEGEMKVPDVDIKGPKVDIDAPDVEVHDPDWHLKMPKMKMPKFSMPGFKAEGPEVDVNLPKADIDVSGPSVDTDAPDLDIEGPEGKLKGSKFKMPKLNIKAPKVSMPDVDLNLKGPKLKGEIDASVPELEGDLRGPQVDVKGPFVEAEVPDVDLECPDAKLKGPKFKMPEMHFKAPKISMPDVDLHLKGPKVKGDADVSVPKLEGDLTGPSVGVEVPDVELECPDAKLKGPKFKMPDMHFKAPKISMPDVDLHLKGPKVKGDVDVSVPKLEGDLTGPSVGVEVPDVELECPDAKLKGPKFKMPEMHFKTPKISMPDVDLHLKGPKVKGDMDVSVPKVEGEMKVPDVDIKGPKMDIDAPDVDVHGPDWHLKMPKMKMPKFSMPGFKAEGPEVDVNLPKADVVVSGPKVDVEVPDVSLEGPEGKLKGPKLKMPEMHFKAPKISMPDVDLHLKGPKVKGDVDVSLPKLEGDLTGPSVDVEVPDVELECPDAKLKGPKFKMPEMHFKTPKISMPDVNLNLKGPKVKGDMDVSVPKVEGEMKVPDVDIRGPKVDIDAPDVDVHGPDWHLKMPKMKMPKFSMPGFKGEGPEVDVNLPKADVDVSGPKVDVEVPDVSLEGPEGKLKGPKFKMPEMHFKTPKISMPDVDFNLKGPKIKGDVDVSAPKLEGELKGPELDVKGPKLDADMPEVAVEGPNGKWKTPKFKMPDMHFKAPKISMPDLDLHLKSPKAKGEVDVDVPKLEGDLKGPHVDVSGPDIDIEGPEGKLKGPKFKMPDMHFKAPNISMPDVDLNLKGPKIKGDVDVSVPEVEGKLEVPDMNIRGPKVDVNAPDVQAPDWHLKMPKMKMPKFSMPGFKAEGPEVDVNLPKADVDISGPKVDIEGPDVNIEGPEGKLKGPKLKMPEMNIKAPKISMPDFDLHLKGPKVKGDVDVSLPKVEGDLKGPEVDIKGPKVDINAPDVGVQGPDWHLKMPKVKMPKFSMPGFKGEGPDGDVKLPKADIDVSGPKVDIEGPDVNIEGPEGKLKGPKFKMPEMNIKAPKISMPDIDLNLKGPKVKGDVDVSLPKVEGDLKGPEVDIKGPKVDIDAPDVDVHGPDWHLKMPKIKMPKISMPGFKGEGPDVDVNLPKADIDVSGPKVDVECPDVNIEGPEGKWKSPKFKMPEMHFKTPKISMPDIDLNLTGPKIKGDVDVTGPKVEGDLKGPEVDLKGPKVDIDVPDVNVQGPDWHLKMPKMKMPKFSMPGFKAEGPEVDVNLPKADVDVSGPKVDVEGPDVNIEGPEGKLKGPKFKMPEMNIKAPKIPMPDFDLHLKGPKVKGDVDISLPKVEGDLKGPEVDIRGPQVDIDVPDVGVQGPDWHLKMPKVKMPKFSMPGFKGEGPDVDVNLPKADLDVSGPKVDIDVPDVNIEGPEGKLKGPKFKMPEMNIKAPKISMPDIDLNLKGPKVKGDMDVSLPKVEGDMKVPDVDIKGPKVDINAPDVDVQGPDWHLKMPKIKMPKISMPGFKGEGPEVDVNLPKADLDVSGPKVDVDVPDVNIEGPDAKLKGPKFKMPEMNIKAPKISMPDLDLNLKGPKMKGEVDVSLANVEGDLKGPALDIKGPKIDVDAPDIDIHGPDAKLKGPKLKMPDMHVNMPKISMPEIDLNLKGSKLKGDVDVSGPKLEGDIKAPSLDIKGPEVDVSGPKLNIEGKSKKSRFKLPKFNFSGSKVQTPEVDVKGKKPDIDITGPKVDINAPDVEVQGKVKGSKFKMPFLSISSPKVSMPDVELNLKSPKVKGDLDIAGPNLEGDFKGPKVDIKAPEVNLNAPDVDVHGPDWNLKMPKMKMPKFSVSGLKAEGPDVAVDLPKGDINIEGPSMNIEGPDLNVEGPEGGLKGPKFKMPDMNIKAPKISMPDIDLNLKGPKVKGDVDISLPKLEGDLKGPEVDIKGPKVDINAPDVDVHGPDWHLKMPKVKMPKFSMPGFKGEGPEVDVTLPKADIDISGPNVDVDVPDVNIEGPDAKLKGPKFKMPEMNIKAPKISMPDFDLNLKGPKMKGDVVVSLPKVEGDLKGPEVDIKGPKVDIDTPDINIEGSEGKFKGPKFKIPEMHLKAPKISMPDIDLNLKGPKVKGDVDVSLPKMEGDLKGPEVDIKGPKVDINAPDVDVQGPDWHLKMPKVKMPKFSMPGFKGEGPDVDVNLPKADLDVSGPKVDIDVPDVNIEGPEGKLKGPKFKMPEMNIKAPKISMPDIDLNLKGPKVKGDMDVSLPKVEGDMQVPDLDIKGPKVDINAPDVDVRGPDWHLKMPKIKMPKISMPGFKGEGPEVDVNLPKADLDVSGPKVDVDVPDVNIEGPDAKLKGPKFKMPEMNIKAPKISMPDFDLHLKGPKVKGDVDVSLPKMEGDLKAPEVDIKGPKVDIDAPDVDVHGPDWHLKMPKVKMPKFSMPGFKGEGPEVDVNLPKADIDVSGPKVDIDTPDIDIHGPEGKLKGPKFKMPDLHLKAPKISMPEVDLNLKGPKMKGDVDVSLPKVEGDLKGPEVDIKGPKVDIDVPDVDVQGPDWHLKMPKVKMPKFSMPGFKGEGPDVDVNLPKADLDVSGPKVDIDVPDVNIEGPDAKLKGPKFKMPEMNIKAPKISMPDFDLHLKGPKVKGDVDVSLPKVEGDLKGPEVDIKGPKVDIDAPDVDVHGPDWHLKMPKVKMPKFSMPGFKGEGPDVDVTLPKADIEISGPKVDIDAPDVSIEGPDAKLKGPKFKMPEMNIKAPKISMPDIDFNLKGPKVKGDVDVSLPKVEGDLKGPEIDIKGPSLDIDTPDVNIEGPEGKLKGPKFKMPEMNIKAPKISMPDFDLHLKGPKVKGDVDVSLPKVESDLKGPEVDIEGPEGKLKGPKFKMPDVHFKSPQISMSDIDLNLKGPKIKGDMDISVPKLEGDLKGPKVDVKGPKVGIDTPDIDIHGPEGKLKGPKFKMPDLHLKAPKISMPEVDLNLKGPKVKGDMDISLPKVEGDLKGPEVDIRDPKVDIDVPDVDVQGPDWHLKMPKVKMPKFSMPGFKGEGPDVDVNLPKADIDVSGPKVDVDVPDVNIEGPDAKLKGPKFKMPEMSIKAPKISMPDIDLNLKGPKVKGDVDVTLPKVEGDLKGPEADIKGPKVDINTPDVDVHGPDWHLKMPKVKMPKFSMPGFKGEGPDVDVSLPKADIDVSGPKVDVDIPDVNIEGPDAKLKGPKFKMPEINIKAPKISIPDVDLDLKGPKVKGDFDVSVPKVEGTLKGPEVDLKGPRLDFEGPDAKLSGPSLKMPSLEISAPKVTAPDVDLHLKAPKIGFSGPKLEGGEVDLKGPKVEAPSLDVHMDSPDINIEGPDVKIPKFKKPKFGFGAKSPKADIKSPSLDVTVPEAELNLETPEISVGGKGKKSKFKMPKIHMSGPKIKAKKQGFDLNVPGGEIDASLKAPDVDVNIAGPDAALKVDVKSPKTKKTMFGKMYFPDVEFDIKSPKFKAEAPLPSPKLEGELQAPDLELSLPAIHVEGLDIKAKAPKVKMPDVDISVPKIEGDLKGPKVQANLGAPDINIEGLDAKVKTPSFGISAPQVSIPDVNVNLKGPKIKGDVPSVGLEGPDVDLQGPEAKIKFPKFSMPKIGIPGVKMEGGGAEVHAQLPSLEGDLRGPDVKLEGPDVSLKGPGVDLPSVNLSMPKVSGPDLDLNLKGPSLKGDLDASVPSMKVHAPGLNLSGVGGKMQVGGDGVKVPGIDATTKLNVGAPDVTLRGPSLQGDLAVSGDIKCPKVSVGAPDLSLEASEGSIKLPKMKLPQFGISTPGSDLHVNAKGPQVSGELKGPGVDVNLKGPRISAPNVDFNLEGPKVKGSLGATGEIKGPTVGGGLPGIGVQGLEGNLQMPGIKSSGCDVNLPGVNVKLPTGQISGPEIKGGLKGSEVGFHGAAPDISVKGPAFNMASPESDFGINLKGPKIKGGADVSGGVSAPDISLGEGHLSVKGSGGEWKGPQVSSALNLDTSKFAGGLHFSGPKVEGGVKGGQIGLQAPGLSVSGPQGHLESGSGKVTFPKMKIPKFTFSGRELVGREMGVDVHFPKAEASIQAGAGDGEWEESEVKLKKSKIKMPKFNFSKPKGKGGVTGSPEASISGSKGDLKSSKASLGSLEGEAEAEASSPKGKFSLFKSKKPRHRSNSFSDEREFSGPSTPTGTLEFEGGEVSLEGGKVKGKHGKLKFGTFGGLGSKSKGHYEVTGSDDETGKLQGSGVSLASKKSRLSSSSSNDSGNKVGIQLPEVELSVSTKKE

SEQ ID NO: 102 - protein, 1257 aa, Homo sapiens
MVVALRYVWPLLLCSPCLLIQIPEEYEGHHVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYRSLESDNEEKAFGSSQPSLNGDIKPLGSDDSLADYGGSVDVQFNEDGSFIGQYSGKKEKEAAGGNDSSGATSPINPAVALE

SEQ ID NO: 103 - protein, 1311 aa, Homo sapiens
MSRRKQAKPRSLKDPNCKLEDKTEDGEALDCKKRPEDGEELEDEAVHSCDSCLQVFESLSDITEHKINQCQLTDGVDVEDDPTCSWPASSPSSKDQTSPSHGEGCDFGEEEGGPGLPYPCQFCDKSFSRLSYLKHHEQSHSDKLPFKCTYCSRLFKHKRSRDRHIKLHTGDKKYHCSECDAAFSRSDHLKIHLKTHTSNKPYKCAICRRGFLSSSSLHGHMQVHERNKDGSQSGSRMEDWKMKDTQKCSQCEEGFDFPEDLQKHIAECHPECSPNEDRAALQCVYCHELFVEETSLMNHMEQVHSGEKKNSCSICSESFHTVEELYSHMDSHQQPESCNHSNSPSLVTVGYTSVSSTTPDSNLSVDSSTMVEAAPPIPKSRGRKRAAQQTPDMTGPSSKQAKVTYSCIYCNKQLFSSLAVLQIHLKTMHLDKPEQAHICQYCLEVLPSLYNLNEHLKQVHEAQDPGLIVSAMPAIVYQCNFCSEVVNDLNTLQEHIRCSHGFANPAAKDSNAFFCPHCYMGFLTDSSLEEHIRQVHCDLSGSRFGSPVLGTPKEPVVEVYSCSYCTNSPIFNSVLKLNKHIKENHKNIPLALNYIHNGKKSRALSPLSPVAIEQTSLKMMQAVGGAPARPTGEYICNQCGAKYTSLDSFQTHLKTHLDTVLPKLTCPQCNKEFPNQESLLKHVTIHFMITSTYYICESCDKQFTSVDDLQKHLLDMHTFVFFRCTLCQEVFDSKVSIQLHLAVKHSNEKKVYRCTSCNWDFRNETDLQLHVKHNHLENQGKVHKCIFCGESFGTEVELQCHITTHSKKYNCKFCSKAFHAIILLEKHLREKHCVFETKTPNCGTNGASEQVQKEEVELQTLLTNSQESHNSHDGSEEDVDTSEPMYGCDICGAAYTMETLLQNHQLRDHNIRPGESAIVKKKAELIKGNYKCNVCSRTFFSENGLREHMQTHLGPVKHYMCPICGERFPSLLTLTEHKVTHSKSLDTGNCRICKMPLQSEEEFLEHCQMHPDLRNSLTGFRCVVCMQTVTSTLELKIHGTFHMQKTGNGSAVQTTGRGQHVQKLYKCASCLKEFRSKQDLVKLDINGLPYGLCAGCVNLSKSASPGINVPPGTNRPGLGQNENLSAIEGKGKVGGLKTRCSSCNVKFESESELQNHIQTIHRELVPDSNSTQLKTPQVSPMPRISPSQSDEKKTYQCIKCQMVFYNEWDIQVHVANHMIDEGLNHECKLCSQTFDSPAKLQCHLIEHSFEGMGGTFKCPVCFTVFVQANKLQQHIFSAHGQEDKIYDCTQCPQKFFFQTELQNHTMTQHSS

SEQ ID NO: 104 - protein, 239 aa, Homo sapiens
MAPSVPAAEPEYPKGIRAVLLGPPGAGKGTQAPRLAENFCVCHLATGDMLRAMVASGSELGKKLKATMDAGKLVSDEMVVELIEKNLETPLCKNGFLLDGFPRTVRQAEMLDDLMEKRKEKLDSVIEFSIPDSLLIRRITGRLIHPKSGRSYHEEFNPPKEPMKDDITGEPLIRRSDDNEKALKIRLQAYHTQTTPLIEYYRKRGIHSAIDASQTPDVVFASILAAFSKATCKDLVMFI

SEQ ID NO: 105 - protein, 1140 aa, Homo sapiens [sequence omitted]

SEQ ID NO: 106 - protein, 1133 aa, Homo sapiens
MLAYCVQDATVVDVEKRRNPSKHYVYIINVTWSDSTSQTIYRRYSKFFDLQMQLLDKFPIEGGQKDPKQRIIPFLPGKILFRRSHIRDVAVKRLKPIDEYCRALVRLPPHISQCDEVFRFFEARPEDVNPPKEDYGSSKRKSVWLSSWAESPKKDVTGADATAEPMILEQYVVVSNYKKQENSELSLQAGEVVDVIEKNESGWWFVSTSEEQGWVPATYLEAQNGTRDDSDINTSKTGEVSKRRKAHLRRLDRRWTLGGMVNRQHSREEKYVTVQPYTSQSKDEIGFEKGVTVEVIRKNLEGWWYIRYLGKEGWAPASYLKKAKDDLPTRKKNLAGPVEIIGNIMEISNLLNKKASGDKETPPAEGEGHEAPIAKKEISLPILCNASNGSAVGVPDRTVSRLAQGSPAVARIAPQRAQISSPNLRTRPPPRRESSLGFQLPKPPEPPSVEVEYYTIAEFQSCISDGISFRGGQKAEVIDKNSGGWWYVQIGEKEGWAPASYIDKRKKPNLSRRTSTLTRPKVPPPAPPSKPKEAEEGPTGASESQDSPRKLKYEEPEYDIPAFGFDSEPELSEEPVEDRASGERRPAQPHRPSPASSLQRARFKVGESSEDVALEEETIYENEGFRPYAEDTLSARGSSGDSDSPGSSSLSLTRKNSPKSGSPKSSSLLKLKAEKNAQAEMGKNHSSASFSSSITINTTCCSSSSSSSSSLSKTSGDLKPRSASDAGIRGTPKVRAKKDADANAGLTSCPRAKPSVRPKPFLNRAESQSQEKMDISTLRRQLRPTGQLRGGLKGSKSEDSELPPQTASEAPSEGSRRSSSDLITLPATTPPCPTKKEWEGPATSYMTCSAYQKVQDSEISFPAGVEVQVLEKQESGWWYVRFGELEGWAPSHYLVLDENEQPDPSGKELDTVPAKGRQNEGKSDSLEKIERRVQALNTVNQSKKATPPIPSKPPGGFGKTSGTPAVKMRNGVRQVAVRPQSVFVSPPPKDNNLSCALRRNESLTATDGLRGVRRNSSFSTARSAAAEAKGRLAERAASQGSDSPLLPAQRNSIPVSPVRPKPIEKSQFIHNNLKDVYVSIADYEGDEETAGFQEGVSMEVLERNPNGWWYCQILDGVKPFKGWVPSNYLEKKN

SEQ ID NO: 107 - protein, 2624 aa, Homo sapiens
MFRRARLSVKPNVRPGVGARGSTASNPQRGRESPRPPEPATDSASKPAEPTDVPTVDFGGAEPQEKAPRSSTEKTGGDNDVEESSRSSSTVSQRRKRISSTSSLVKSSVSVPSESHPLSTINQEAPQPTATSTKEKQPCSDRYRIYKAQKLREMLKEELRKEKKQWKNKYAINESQRPPDRSKMTMRDFIYYLPDNNPMTSSLEQEKKTEKPSTPVQTREQEGKSTPNAEDNEMEEETDDGPLLVPRVKVAEDGSIILDEESLTVEVLRTKGPCVVEENDPIFERGSTTTYSSFRKNYYSKPWSNKETDMFFLAISMVGTDFSMIGQLFPHRARIEIKNKFKREEKTNGWRIDKAFQEKRPFDFDFFAHLLQKVLAEEEKRKQKSVKNHSLKEKKSTKPRKNVKVKKVACEGVNNDPDESMSSRISDTERSQKDAQTVEEESLTLSREDAEQVALEVDLNQKKRRRKKQDGANELGVNNLLENATVQAGPSKGEKHKNKCQAIRPELKEGECSKEQMLSCTQNIDGIVGFASTEKVEKRTDPILSLSNQQDATSVATESSESSTSDLPSFEVGIRALCEVNNAEGSCIEERNVDLKNNSLEIDQTENVKPMLRGRFQRPKPNLSRAGKKSVLSQGKTESESKNSHSKTSVEKNHVEKDKMNTLDILRMETTERENPEAETVSVLGEKNCLQEGSQLKALRPVQVRGRLQKPKPNAGKAAERKEILISQEEIGANVEKNENESCADRDTPQHMEDQSCKDFEEEDVILQPEKNDSFQNVQPDEPKVLNECLSVQENNKANKLNQVPILRTRFQKPKPNIGRGTGRREISSKEEVLEKILVSGEMAAALRETVRLDTSPKEMVPAEINTKEMQSDLKETGRRAISPREKILDVIDDTIEMETGLKAMGREICLREKTPEVIDATEEIDKDLEEAGRREISPQKNGPEEVKPLGEVETDLKATGNESSPREKTPEVTDATEEIDKNLEETGRRKISPRENGPEEVKPVDEMETDLNATGRESSPREKTPEVIDATEEIDLEETEREVSPQENGLEEVKPLGEMETDLKATGRDSFPRGKTPEVIDAIEEIEIDLEETEREISPQENGLEEVKPLGEMQTDLKATGREISPREKTPEVIDATEEIDKDLEETGRREISPEENGPEEVKPVDEMETDLKTTGREGSSREKTREVIDAAEVIETDLEETEREISPQENGPEEVKPVGKMETDLKEIREEISQREKVLAEFSAIREKEIDLKETGKRDIPMMEKVSGKMAVVEEMEADLKETGKENFRERGSEEICVTEEKVAELKQTGKTDISPRENELEETSTSRQTDTHLMQSGSNDFSAMPSLDIQNISSEVLSMMHTPVEEKRNSEKEVSSHFSHFKISSQTHESDKTEVQGIQSPDVPEQFSDINLSKSLPQEQKPLEIKPAPFVRSRFKRPKPNLARAALKRETTESEKYIYEKKSETKKMETIVMQENNEQTDTLPSQHDEASLMISREKDTLGHRNEEAVILPCTQTERNLSPSNSCEPKEESQSAPVQKNDSVVSVGTNNVNTFQQEMKESVIQTARQVRGRLQRPRPNIRKTGQRQIVDKGEAKGIIKEGRTILPKDETEKKVLTVSNSQIETEIEVPSSAVPEHRMYENQSQVVLVENLHVNKTNETIRHENKPYVPSSAQMTRRKFQKAKPNLGRAHSKKEEPVLEKVTTDQSKEGKPEDHLLQKGASNTQLLLKEKAELLTSLEVSARKDCVGSKESALAKIDAELEEVGPSRRVGEETVGDNSPSSVVEEQYLNKLTSCPQPLNETSYSKIALDGKTTISSTSEYERNRGERRSHKKFKPNVTRGRGSKRVRGKTSKKEPRASKAMLVTLRASQEEDDDADDFESDYEEESYHLAPEEVNKAPVFVPVGLRSPEPVSAQIEETMEELEITVNVPDVGCIAVVEHELPNTDVTTEEMKQEENLSVPFEMTTSEHIQDEPGTNDGSTEAAITLLTMGDLVLQSEISSEQGDVGVCILPHVHSKDKSHIPSSLDNVNHKIVHECQELSSPVITTSPASFEENKIVLEEQSSREEISLMEKVKENATPTRNTISKVTSNLRIRSRLAKPKPNLEKTLGTNRLDDYQEVSSLCVTKGAEMETQRETEKNASKATELENKNLGPVTTAENKDQSKLACVHGIKGTSISSEVNLTERNENQEESSQEVHMLSVAPVASSETGPCTLGLDRGLGENSVEEPQIKDSKGDSVLTLPVPEYTPTSIPEVQQENIINPQDLTVNLVANVPQDGEDEQAFILTLVEIPANAVEEFTDATAQFMPNPLLPAPILVKSVNTEERGDMSICLPATSVGQDAMGLSISGRDNSKKPPDNLDLVSRKRFQCRLDKNDHIPPAKKRSLTLRDDCQEYTTEVHSKELTNVFEETGESHKGQDIFLTSGSTLTTPEPQRQQVEAAFQSRGSRSPDACMDKNVPQLPQDEMIVSDKEERTDAAPKSQQMDSRTSSSKASLSRPGRRPLGFLSLICSKNSLESDEPMQVHSKKRLKPLIPGLRKKLKRSNPFNESQEKNRESSDLLPSPSVITTQSENISSSATQVSCDQPLLKEGYKSAQKRAPQGEATTVSEYFFNDIFIEVDETE

SEQ ID NO: 108 - protein, 638 aa, Homo sapiens
MDLWQLLLTLALAGSSDAFSGSEATAAILSRAPWSLQSVNPGLKTNSSKEPKFTKCRSPERETFSCHWTDEVHHGTKNLGPIQLFYTRRNTQEWTQEWKECPDYVSAGENSCYFNSSFTSIWIPYCIKLTSNGGTVDEKCFSVDEIVQPDPPIALNWTLLNVSLTGIHADIQVRWEAPRNADIQKGWMVLEYELQYKEVNETKWKMMDPILTTSVPVYSLKVDKEYEVRVRSKQRNSGNYGEFSEVLYVTLPQMSQFTCEEDFYFPWLLIIIFGIFGLTVMLFVFLFSKQQRIKMLILPPVPVPKIKGIDPDLLKEGKLEEVNTILAIHDSYKPEFHSDDSWVEFIELDIDEPDEKTEESDTDRLLSSDHEKSHSNLGVKDGDSGRTSCCEPDILETDFNANDIHEGTSEVAQPQRLKGEADLLCLDQKNQNNSPYHDACPATQQPSVIQAEKNKPQPLPTEGAESTHQAAHIQLSNPSSLSNIDFYAQVSDITPAGSVVLSPGQKNKAGMSQCDMHPEMVSLCQENFLMDNAYFCEADAKKCIPVAPHIKVESHIQPSLNQEDIYITTESLTTAAGRPGTGEHVPGSEMPVPDYTSIHIVQSPQGLILNATALPLPDKEFLSSCGYVSTDQLNKIMP

SEQ ID NO: 109 - protein, 643 aa, Homo sapiens
MAAVLALRVVAGLAAAALVAMLLEHYGLAGQPSPLPRPAPPRRPHPAPGPGDSNIFWGLQISDIHLSRFRDPGRAVDLEKFCSETIDIIQPALVLATGDLTDAKTKEQLGSRQHEVEWQTYQGILKKTRVMEKTKWLDIKGNHDAFNIPSLDSIKNYYRKYSAVRRDGSFHYVHSTPFGNYSFICVDATVNPGPKRPYNFFGILDKKKMEELLLLAKESSRSNHTIWFGHFTTSTILSPSPGIRSIMSSAIAYLCGHLHTLGGLMPVLHTRHFQGTLELEVGDWKDNRRYRIFAFDHDLFSFADLIFGKWPVVLITNPKSLLYSCGEHEPLERLLHSTHIRVLAFSLSSITSVTVKIDGVHLGQAVHVSGPIFVLKWNPRNYSSGTHNIEVIVQDSAGRSKSVHHIFSVQENNHLSFDPLASFILRTDHYIMARVLFVLIVLSQLTILIIFRYRGYPELKEPSGFINLTSFSLHVLSKINIFYYSVLLLTLYTVLGPWFFGEIIDGKFGCCFSFGIFVNGHFLQGSITFIIGILQLAFFNIPLMAYMCWSLLQRCFGHNFRSHLHQRKYLKIMPVHLLMLLLYIWQVYSCYFLYATYGTLAFLFSPLRTWLTLLTPVLIRYVWTLNSTKFGIFMVQLKSHLSS

SEQ ID NO: 110 - protein, 3546 aa, Homo sapiens
MCENCADLVEVLNEISDVEGGDGLQLRKEHTLKIFTYINSWTQRQCLCCFKEYKHLEIFNQVVCALINLVIAQVQVLRDQLCKHCTTINIDSTWQDESNQAEEPLNIDRECNEGSTERQKSIEKKSNSTRICNLTEEESSKSSDPFSLWSTDEKEKLLLCVAKIFQIQFPLYTAYKHNTHPTIEDISTQESNILGAFCDMNDVEVPLHLLRYVCLFCGKNGLSLMKDCFEYGTPETLPFLIAHAFITVVSNIRIWLHIPAVMQHIIPFRTYVIRYLCKLSDQELRQSAARNMADLMWSTVKEPLDTTLCFDKESLDLAFKYFMSPTLTMRLAGLSQITNQLHTFNDVCNNESLVSDTETSIAKELADWLISNNVVEHIFGPNLHIEIIKQCQVILNFLAAEGRLSTQHIDCIWAAAQLKHCSRYIHDLFPSLIKNLDPVPLRHLLNLVSALEPSVHTEQTLYLASMLIKALWNNALAAKAQLSKQSSFASLLNTNIPIGNKKEEEELRRTAPSPWSPAASPQSSDNSDTHQSGGSDIEMDEQLINRTKHVQQRLSDTEESMQGSSDETANSGEDGSSGPGSSSGHSDGSSNEVNSSHASQSAGSPGSEVQSEDIADIEALKEEDEDDDHGHNPPKSSCGTDLRNRKLESQAGICLGDSQGMSERNGTSSGTGKDLVFNTESLPSVDNRMRMLDACSHSEDPEHDISGEMNATHIAQGSQESCITRTGDFLGETIGNELFNCRQFIGPQHHHHHHHHHHHHDGHMVDDMLSADDVSCSSSQVSAKSEKNMADFDGEESGCEEELVQINSHAELTSHLQQHLPNLASIYHEHLSQGPVVHKHQFNSNAVTDINLDNVCKKGNTLLWDIVQDEDAVNLSEGLINEAEKLLCSLVCWFTDRQIRMRFIEGCLENLGNNRSVVISLRLLPKLFGTFQQFGSSYDTHWITMWAEKELNMMKLFFDNLVYYIQTVREGRQKHALYSHSAEVQVRLQFLTCVFSTLGSPDHFRLSLEQVDILWHCLVEDSECYDDALHWFLNQVRSKDQHAMGMETYKHLFLEKMPQLKPETISMTGLNLFQHLCNLARLATSAYDGCSNSELCGMDQFWGIALRAQSGDVSRAAIQYINSYYINGKTGLEKEQEFISKCMESLMIASSSLEQESHSSLMVIERGLLMLKTHLEAFRRRFAYHLRQWQIEGTGISSHLKALSDKQSLPLRVVCQPAGLPDKMTIEMYPSDQVADLRAEVTHWYENLQKEQINQQAQLQEFGQSNRKGEFPGGLMGPVRMISSGHELTTDYDEKALHELGFKDMQMVFVSLGAPRRERKGEGVQLPASCLPPPQKDNIPMLLLLQEPHLTTLFDLLEMLASFKPPSGKVAVDDSESLRCEELHLHAENLSRRVWELLMLLPTCPNMLMAFQNISDEQSNDGFNWKELLKIKSAHKLLYALEIIEALGKPNRRIRRESTGSYSDLYPDSDDSSEDQVENSKNSWSCKFVAAGGLQQLLEIFNSGILEPKEQESWTVWQLDCLACLLKLICQFAVDPSDLDLAYHDVFAWSGIAESHRKRTWPGKSRKAAGDHAKGLHIPRLTEVFLVLVQGTSLIQRLMSVAYTYDNLAPRVLKAQSDHRSRHEVSHYSMWLLVSWAHCCSLVKSSLADSDHLQDWLKKLTLLIPETAVRHESCSGLYKLSLSGLDGGDSINRSFLLLAASTLLKFLPDAQALKPIRIDDYEEEPILKPGCKEYFWLLCKLVDNIHIKDASQTTLLDLDALARHLADCIRSREILDHQDGNVEDDGLTGLLRLATSVVKHKPPFKFSREGQEFLRDIFNLLFLLPSLKDRQQPKCKSHSSRAAAYDLLVEMVKGSVENYRLIHNWVMAQHMQSHAPYKWDYWPHEDVRAECRFVGLTNLGATCYLASTIQQLYMIPEARQAVFTAKYSEDMKHKTTLLELQKMFTYLMESECKAYNPRPFCKTYTMDKQPLNTGEQKDMTEFFTDLITKIEEMSPELKNTVKSLFGGVITNNVVSLDCEHVSQTAEEFYTVRCQVADMKNIYESLDEVTIKDTLEGDNMYTCSHCGKKVRAEKRACFKKLPRILSFNTMRYTFNMVTMMKEKVNTHFSFPLRLDMTPYTEDFLMGKSERKEGFKEVSDHSKDSESYEYDLIGVTVHTGTADGGHYYSFIRDIVNPHAYKNNKWYLFNDAEVKPFDSAQLASECFGGEMTTKTYDSVTDKFMDFSFEKTHSAYMLFYKRMEPEEENGREYKFDVSSELLEWIWHDNMQFLQDKNIFEHTYFGFMWQLCSCIPSTLPDPKAVSLMTAKLSTSFVLETFIHSKEKPTMLQWIELLTKQFNNSQAACEWFLDRMADDDWWPMQILIKCPNQIVRQMFQRLCIHVIQRLRPVHAHLYLQPGMEDGSDDMDTSVEDIGGRSCVTRFVRTLLLIMEHGVKPHSKHLTEYFAFLYEFAKMGEEESQFLLSLQAISTMVHFYMGTKGPENPQVEVLSEEEGEEEEEEEDILSLAEEKYRPAALEKMIALVALLVEQSRSERHLTLSQTDMAALTGGKGFPFLFQHIRDGINIRQTCNLIFSLCRYNNRLAEHIVSMLFTSIAKLTPEAANPFFKLLTMLMEFAGGPPGMPPFASYILQRIWEVIEYNPSQCLDWLAVQTPRNKLAHSWVLQNMENWVERFLLAHNYPRVRTSAAYLLVSLIPSNSFRQMFRSTRSLHIPTRDLPLSPDTTVVLHQVYNVLLGLLSRAKLYVDAAVHGTTKLVPYFSFMTYCLISKTEKLMFSTYFMDLWNLFQPKLSEPAIATNHNKQALLSFWYNVCADCPENIRLIVQNPVVTKNIAFNYILADHDDQDVVLFNRGMLPAYYGILRLCCEQSPAFTRQLASHQNIQWAFKNLTPHASQYPGAVEELFNLMQLFIAQRPDMREEELEDIKQFKKTTISCYLRCLDGRSCWTTLISAFRILLESDEDRLLVVFNRGLILMTESFNTLHMMYHEATACHVTGDLVELLSIFLSVLKSTRPYLQRKDVKQALIQWQERIEFAHKLLTLLNSYSPPELRNACIDVLKELVLLSPHDFLHTLVPFLQHNHCTYHHSNIPMSLGPYFPCRENIKLIGGKSNIRPPRPELNMCLLPTMVETSKGKDDVYDRMLLDYFFSYHQFIHLLCRVAINCEKFTETLVKLSVLVAYEGLPLHLALFPKLWTELCQTQSAMSKNCIKLLCEDPVFAEYIKCILMDERTFLNNNIVYTFMTHFLLKVQSQVFSEANCANLISTLITNLISQYQNLQSDFSNRVEISKASASLNGDLRALALLLSVHTPKQLNPALIPTLQELLSKCRTCLQQRNSLQEQEAKERKTKDDEGATPIKRRRVSSDEEHTVDSCISDMKTETREVLTPTSTSDNETRDSSIIDPGTEQDLPSPENSSVKEYRMEVPSSFSEDMSNIRSQHAEEQSNNGRYDDCKEFKDLHCSKDSTLAEEESEFPSTSISAVLSDLADLRSCDGQALPSQDPEVALSLSCGHSRGLFSHMQQHDILDTLCRTIESTIHVVTRISGKGNQAAS

SEQ ID NO: 111 - protein, 389 aa, Homo sapiens
MGASDPEVAPWARGGAAGMAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSVSDTPGGLGNDQNPGSQFSQALAIRSYTKFVMGIAVSMLTYPFLLVGDLMAVNNCGLQAGLPPYSPVFKSWIHCWKYLSVQGQLFRGSSLLFRRVSSGSCFALE

SEQ ID NO: 112 - protein, 721 aa, herpes simplex virus 7
MNSLQSLCVLCSRLSECALELECLRFCDPVTLIPDMTNFRKNGVVIIHLFKTLFAELCHQNFNCASPVTIYLQILLKAMYNQVLLLDASIHQFLLDNDKQKYFENIFQLNECKQHLKLDLALNNYLTFSVDISTINDIEKLLCKMNCIFGLISPLDGINACSQIIEFLTILCGVCVVMKPEVFSETTTCLKCYEELSLVPNQGKSIRKRLAGKFCNHLTETHMVSNLEKNVDIIEKDLDFSTKQYGLVKEYMAKITNIFQQQLYSKPPHLQEAENTLINFDLFSKIPDTIYSLSEFTYWSKISESVIQKASITLNQLNLCHSLYADLQNEISKFLYGETIQDVFNFNEENVTNDDKLYIGSRFISPCRLVDIITNVSIKNLEEDPVFTKLAEEDEIQTKIKTLLNELENSAHETVPKKYVTHSMTQDHNLQQEIHIRKKAYYQKISESGYSKVMLCIKEQEALINKLMNINILGNHIFESLSKMMNAFANRQLQSLENFSADPFTYDDHLYIKNNLLSKKLPQELLPNLSQEMYRLLTGPLSNYHTASFPLSSNISMAYACDVADFLPHMKEDLAKCVEGTIYPENWMLCTYNKFFNFDGLHNINDMQRQMWNFIRELVLSVALYNDVFGKQLSIVKFGEETETVEKILLTFDSGSPLLFKRGTTTTKFNDLYSLLYFDLKTQCDPVQISQTKQVSHIPAPNLLDLCRQNENSIPECFYNF

SEQ ID NO: 113 - protein, 967 aa, Homo sapiens
MPSPPGLRALWLCAALCASRRAGGAPQPGPGPTACPAPCHCQEDGIMLSADCSELGLSAVPGDLDPLTAYLDLSMNNLTELQPGLFHHLRFLEELRLSGNHLSHIPGQAFSGLYSLKILMLQNNQLGGIPAEALWELPSLQSLRLDANLISLVPERSFEGLSSLRHLWLDDNALTEIPVRALNNLPALQAMTLALNRISHIPDYAFQNLTSLVVLHLHNNRIQHLGTHSFEGLHNLETLDLNYNKLQEFPVAIRTLGRLQELGFHNNNIKAIPEKAFMGNPLLQTIHFYDNPIQFVGRSAFQYLPKLHTLSLNGAMDIQEFPDLKGTTSLEILTLTRAGIRLLPSGMCQQLPRLRVLELSHNQIEELPSLHRCQKLEEIGLQHNRIWEIGADTFSQLSSLQALDLSWNAIRSIHPEAFSTLHSLVKLDLTDNQLTTLPLAGLGGLMHLKLKGNLALSQAFSKDSFPKLRILEVPYAYQCCPYGMCASFFKASGQWEAEDLHLDDEESSKRPLGLLARQAENHYDQDLDELQLEMEDSKPHPSVQCSPTPGPFKPCEYLFESWGIRLAVWAIVLLSVLCNGLVLLTVFAGGPVPLPPVKFVVGAIAGANTLTGISCGLLASVDALTFGQFSEYGARWETGLGCRATGFLAVLGSEASVLLLTLAAVQCSVSVSCVRAYGKSPSLGSVRAGVLGCLALAGLAAALPLASVGEYGASPLCLPYAPPEGQPAALGFTVALVMMNSFCFLVVAGAYIKLYCDLPRGDFEAVWDCAMVRHVAWLIFADGLLYCPVAFLSFASMLGLFPVTPEAVKSVLLVVLPLPACLNPLLYLLFNPHFRDDLRRLRPRAGDSGPLAYAAAGELEKSSCDSTQALVAFSDVDLILEASEAGRPPGLETYGFPSVTLISCQQPGAPRLEGSHCVEPEGNHFGNPQPSMDGELLLRAEGSTPAGGGLSGGGGFQPSGLAFASHV

SEQ ID NO: 114 - protein, 867 aa, Homo sapiens
MTENKTVSSSSTRDDQTNIGLTCQEVKALREKAWSRTNEGNAMSQSLVLYGASKENSEGFHESKMTNTEGVNKGIYFSYPCRRHSCAVVNIPAPCVNKMISHIQDVESKIQEHLKRFETSFEEWSRTSSTKDLKEDWSVTTPVKEVKPGEKRDEKCPELKQEMETLLSEAIRLIKSLETDRADAEEALKQQRSRKNMINMKIDSWSVWKLQELPLAVQKEHEAYLSDVIELQWHLEDKANQLQHFEKQKTELEEANAKIQADIDYMNEHGPLLDSKQNQELQDLKNHYKKKMEVMDLHRKVNEELEEALEACENARLKAQQIKEEIDKDIYQDEKTIEAYKREIYQLNSLFDHYSSSVINVNTNIEEKEEEVTEAIRETKSSKNELHSLSKMLEDLRRVYDQLTWKQKSHENQYLEAVNDFYAAKKTWDIELSDVAKDFSAISLACTKLTEDNKKLEIDINKITVKTNESIRKKSKYESEIKYLTIMKLKNDKHLKNIYKEAYRIGTLFHLTKHKTDEMEDKIAEVRRKFKGREEFLKKLTQGEVAAGMVLQKKLYSIYEVQALERKELIKNRAICAMSLAELQEPLLQLEDEAERIRSLDKEHSVMLNNIIDQKDLIRRKVGKVKKKLRKKGKKTLDALIETESKRSAIFKDLEATKSKTMIFYAKINELNEELKAKEEEKKSFDQTLEILKNKFITMRFKREHAQTVFDHYMQEKKDCEERIFEEDQRFRVLLAVRQKTLQDTQKIIADSLEENLRLAQEYQQLQITFLKEKDNYFNIYDKQLSLDTSIRDKKQLCQLQRRMHTLWQEHFKLVVLFSQMRLANFQTDSQESIQKILAVQEESSNLMQHILGFFQTLTDGTCENDG

SEQ ID NO: 115 - protein, 299 aa, Homo sapiens
MHSLATAAPVPTTLAQVDREKIYQWINELSSPETRENALLELSKKRESVPDLAPMLWHSFGTIAALLQEIVNIYPSINPPTLTAHQSNRVCNALALLQCVASHPETRSAFLAAHIPLFLYPFLHTVSKTRPFEYLRLTSLGVIGALVKTDEQEVINFLLTTEIIPLCLRIMESGSELSKTVATFILQKILLDDTGLAYICQTYERFSHVAMILGKMVLQLSKEPSARLLKHVVRCYLRLSDNPRAREALRQCLPDQLKDTTFAQVLKDDTTTKRWLAQLVKNLQEGQVTDPRGIPLPPQ

SEQ ID NO: 116 - protein, 438 aa, Homo sapiens
MALRGVSVRLLSRGPGLHVLRTWVSSAAQTEKGGRTQSQLAKSSRPEFDWQDPLVLEEQLTTDEILIRDTFRTYCQERLMPRILLANRNEVFHREIISEMGELGVLGPTIKGYGCAGVSSVAYGLLARELERVDSGYRSAMSVQSSLVMHPIYAYGSEEQRQKYLPQLAKGELLGCFGLTEPNSGSDPSSMETRAHYNSSNKSYTLNGTKTWITNSPMADLFVVWARCEDGCIRGFLLEKGMRGLSAPRIQGKFSLRASATGMIIMDGVEVPEENVLPGASSLGGPFGCLNNARYGIAWGVLGASEFCLHTARQYALDRMQFGVPLARNQLIQKKLADMLTEITLGLHACLQLGRLKDQDKAAPEMVSLLKRNNCGKALDIARQARDMLGGNGISDEYHVIRHAMNLEAVNTYEGTHDIHALILGRAITGIQAFTASK

SEQ ID NO: 117 - protein, 519 aa, Homo sapiens
MAAEAADLGLGAAVPVELRRERRMVCVEYPGVVRDVAKMLPTLGGEEGVSRIYADPTKRLELYFRPKDPYCHPVCANRFSTSSLLLRIRKRTRRQKGVLGTEAHSEVTFDMEILGIISTIYKFQGMSDFQYLAVHTEAGGKHTSMYDKVLMLRPEKEAFFHQELPLYIPPPIFSRLDAPVDYFYRPETQHREGYNNPPISGENLIGLSRARRPHNAIFVNFEDEEVPKQPLEAAAQTWRRVCTNPVDRKVEEELRKLFDIRPIWSRNAVKANISVHPDKLKVLLPFIAYYMITGPWRSLWIRFGYDPRKNPDAKIYQVLDFRIRCGMKHGYAPSDLPVKAKRSTYNYSLPITVKKTSSQLVTMHDLKQGLGPSGTSGARKPASSKYKLKDSVYIFREGALPPYRQMFYQLCDLNVEELQKIIHRNDGAENSCTERDGWCLPKTSDELRDTMSLMIRQTIRSKRPALFSSSAKADGGKEQLTYESGEDEEDEEEEEEEEEDFKPSDGSENEMETEILDYV

SEQ ID NO: 118 - protein, 373 aa, Homo sapiens
MPRGGMDDHWPSSDDQGHDPKEPEQLRKLFIGGLSFETTDDSLREHFEQWGKLTDCVVMRDPQTKRSRGFGFVTYSCVEEVDASMSARPHKVDGRVVEPKRAVSREDSARPGAHLTVKKIFVGGIKEDTEEYHLRDYSESYGKIETIEVMEDRQSGKKRGFAFVTFDDHDTVDKIVVQKYHTINGHNCEVKKALSKQEMQTASAQRGRGGGGSNFMGRGGNYGGGDGGNFGRGGGGGFGNRGGYGGGGGRGGGGYGGGGDGYNGFGGDGGNYGGGPGYGGRGYGGSPGYGNQGGGYGGGGGGYDGYNESGNFGGGNYNDFGNYGGQQQSNYGPMKGGSFSGRSSGGSGSGPYGGGYGSGGGGGGGGSYGGRRF

SEQ ID NO: 119 - protein, 589 aa, Homo sapiens
MAAADGDDSLYPIAVLIDELRNEDVQLRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQDSVRLLAVEACVNIAQLLPQEDLEALVMPTLRQAAEDKSWRVRYMVADKFTELQKAVGPEITKTDLVPAFQNLMKDCEAEVRAAASHKVKEFCENLSADCRENVIMSQILPCIKELVSDANQHVKSALASVIMGLSPILGKDNTIEHLLPLFLAQLKDECPEVRLNIISNLDCVNEVIGIRQLSQSLLPAIVELAEDAKWRVRLAIIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPILEKLTQDQDVDVKYFAQEALTVLSLA

SEQ ID NO: 120 - protein, 466 aa, Homo sapiens
MRLRTRKASQQSNQIQTQRTARAKRKYSEVDDSLPSGGEKPSKNETGLLSSIKKFIKGSTPKEERENPSKRSRIERDIDNNLITSTPRAGEKPNKQISRVRRKSQVNGEAGSYEMTNQHVKQNGKLEDNPSSGSPPRTTLLGTIFSPVFNFFSPANKNGTSGSDSPGQAVEAEEIVKQLDMEQVDEITTSTTTSTNGAAYSNQAVQVRPSLNNGLEEAEETVNRDIPPLTAPVTPDSGYSSAHAEATYEEDWEVFDPYYFIKHVPPLTEEQLNRKPALPLKTRSTPEFSLVLDLDETLVHCSLNELEDAALTFPVLFQDVIYQVYVRLRPFFREFLERMSQMYEIILFTASKKVYADKLLNILDPKKQLVRHRLFREHCVCVQGNYIKDLNILGRDLSKTIIIDNSPQAFAYQLSNGIPIESWFMDKNDNELLKLIPFLEKLVELNEDVRPHIRDRFRLHDLLPPD

SEQ ID NO: 121 - protein, 1500 aa, Homo sapiens
MTRILTAFKVVRTLKTGFGFTNVTAHQKWKFSRPGIRLLSVKAQTAHIVLEDGTKMKGYSFGHPSSVAGEVVFNTGLGGYPEAITDPAYKGQILTMANPIIGNGGAPDTTALDELGLSKYLESNGIKVSGLLVLDYSKDYNHWLATKSLGQWLQEEKVPAIYGVDTRMLTKIIRDKGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGIMHESKPFFAVQFHPEVTPGPIDTEYLFDSFFSLIKKGKATTITSVLPKPALVASRVEVSKVLILGSGGLSIGQAGEFDYSGSQAVKAMKEENVKTVLMNPNIASVQTNEVGLKQADTVYFLPITPQFVTEVIKAEQPDGLILGMGGQTALNCGVELFKRGVLKEYGVKVLGTSVESIMATEDRQLFSDKLNEINEKIAPSFAVESIEDALKAADTIGYPVMIRSAYALGGLGSGICPNRETLMDLSTKAFAMTNQILVEKSVTGWKEIEYEVVRDADDNCVTVCNMENVDAMGVHTGDSVVVAPAQTLSNAEFQMLRRTSINVVRHLGIVGECNIQFALHPTSMEYCIIEVNARLSRSSALASKATGYPLAFIAAKIALGIPLPEIKNVVSGKTSACFEPSLDYMVTKIPRWDLDRFHGTSSRIGSSMKSVGEVMAIGRTFEESFQKALRMCHPSIEGFTPRLPMNKEWPSNLDLRKELSEPSSTRIYAIAKAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIEKVKDATRKIAKAFAISGPFNVQFLVKGNDVLVIECNLRASRSFPFVSKTLGVDFIDVATKVMIGENVDEKHLPTLDHPIIPADYVAIKAPMFSWPRLRDADPILRCEMASTGEVACFGEGIHTAFLKAMLSTGFKIPQKGILIGIQQSFRPRFLGVAEQLHNEGFKLFATEATSDWLNANNVPATPVAWPSQEGQNPSLSSIRKLIRDGSIDLVINLPNNNTKFVHDNYVIRRTAVDSGIPLLTNFQVTKLFAEAVQKSRKVDSKSLFHYRQYSAGKAA

SEQ ID NO: 122 - protein, 654 aa, Homo sapiens
MKLSLVAAMLLLLSAARAEEEDKKEDVGTVVGIDLGTTYSCVGVFKNGRVEIIANDQGNRITPPYVAFTPEGERLIGDAAKNQLTSNPENTVFDAKRLIGRTWNDPSVQQDIKFLPFKVVEKKTKPYIQVDIGGGQTKTFAPEEISAMVLTKMKETAEAYLGKKVTHAVVTVPAYFNDAQRQATKDAGTIAGLNVMRIINEPTAAAIAYGLDKREGEKNILVFDLGGGTFDVSLLTIDNGVFEVVATNGDTHLGGEDFDQRVMEHFIKLYKKKTGKDVRKDNRAVQKLRREVEKAKRALSSQHQARIEIESFYEGEDFSETLTRAKFEELNMDLFRSTMKPVQKVLEDSDLKKSDIDEIVLVGGSTRIPKIQQLVKEFFNGKEPSRGINPDEAVAYGAAVQAGVLSGDQDTGDLALLDVCPLTLGIETVGGVMTKLIPRNTVVPTKKSQIFSTASDNQPTVTIKVYEGERPLTKDNHLLGTFDLTGIPPAPRGVPQIEVTFEIDVNGILRVTAEDKGTGNKNKITITNDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 123 - protein, 277 aa, Homo sapiens
MSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSIDAIPDNQKFKQLQRELSQVLTQRQIYIQPDN

SEQ ID NO: 124 - protein, 341 aa, Homo sapiens
MAKGLLVTYALWAVGGPAGLHHLYLGRDSHALLWMLTLGGGGLGWLWEFWKLPSFVAQANRAQGQRQSPRGVTPPLSPIRFAAQVIVGIYFGLVALISLSSMVNFYIVALPLAVGLGVLLVAAVGNQTSDFKNTLGAAFLTSPIFYGRPIAILPISVAASITAQKRRRYKALVASEPLSVRLYRLGLAYLAFTGPLAYSALCNTAATLSYVAETFGSFLNWFSFFPLLGRLMEFVLLLPYRIWRLLMGETGFNSSYFQEWAKLYEFVHSFQDEKRQLAYQVLGLSEGATNEEIHRSYRELVKVWHPDHNLDQTEEAQRHFLEIQAAYEVLSQPRKPRGSRR

SEQ ID NO: 125 - protein, 409 aa, Homo sapiens
MQRRRRPPPPTSRLPEGCGGGGGGSEEVEVQFSAGRWGSAAAVSAAAAAATRSTEEEEERLEREHFWKIINAFRYYGTSMHERVNRTERQFRSLPANQQKLLPQFLLHLDKIRKCIDHNQEILLTIVNDCIHMFENKEYGEDGNGKIMPASTFDMDKLKSTLKQFVRDWSETGKAERDACYQPIIKEILKNFPKERWDPSKVNILVPGAGLGRLAWEIAMLGYACQGNEWSFFMLFSSNFVLNRCSEINKYKLYPWIHQFSNNRRSADQIRPIFFPDVDPHSLPPGSNFSMTAGDFQEIYSECNTWDCIATCFFIDTAHNVIDYIDTIWKILKPGGIWINLGPLLYHFENLANELSIELSYEDIKNVVLQYGFKVEVEKESVLSTYTVNDLSMMKYYYECVLFVVRKPQ

SEQ ID NO: 126 - protein, 4646 aa, Homo sapiens [sequence omitted]

SEQ ID NO: 127 - protein, 507 aa, Homo sapiens
MRRLPRALLLQLRLALLVAAGAPEVLVSAPRSLVWGPGLQAAVVLPVRYFYLQAVNSEGQNLTRSPAGETPFKVVVKSLSPKELVRIHVPKPLDRNDGTFLMRYRMYETVDEGLKIEVLYGDEHVAQSPYILKGPVYHEYCECPEDPQAWQKTLSCPTKEPQIAKDFASFPSINLQQMLKEVPKRFGDERGAIVHYTILNNHVYRRSLGKYTDFKMFSDEILLSLTRKVLLPDLEFYVNLGDWPLEHRKVNGTPSPIPIISWCGSLDSRDVVLPTYDITHSMLEAMRGVTNDLLSIQGNTGPSWINKTERAFFRGRDSREERLQLVQLSKENPQLLDAGITGYFFFQEKEKELGKAKLMGFFDFFKYKYQVNVDGTVAAYRYPYLMLGDSLVLKQDSPYYEHFYMALEPWKHYVPIKRNLSDLLEKVKWAKENDEEAKKIAKEGQLMARDLLQPHRLYCYYYQVLQKYAERQSSKPEVRDGMELVPQPEDSTAICQCHRKKPSREEL

SEQ ID NO: 128 - protein, 332 aa, Homo sapiens
MSEAGEEQPMETTGATENGHEAVPEASRGRGWTGAAAGAGGATAAPPSGNQNGAEGDQINASKNEEDAGKMFVGGLSWDTSKKDLKDYFTKFGEVVDCTIKMDPNTGRSRGFGFILFKDAASVEKVLDQKEHRLDGRVIDPKKAMAMKKDPVKKIFVGGLNPESPTEEKIREYFGEFGEIEAIELPMDPKLNKRRGFVFITFKEEEPVKKVLEKKFHTVSGSKCEIKVAQPKEVYQQQQYGSGGRGNRNRGNRGSGGGGGGGGQSQSWNQGYGNYWNQGYGYQQGYGPGYGGYDYSPYGYYGYGPGYDYSQGSTNYGKSQRRGGHQNNYKPY

SEQ ID NO: 129 - protein, 547 aa, Homo sapiens
MEDSEALGFEHMGLDPRLLQAVTDLGWSRPTLIQEKAIPLALEGKDLLARARTGSGKTAAYAIPMLQLLLHRKATGPVVEQAVRGLVLVPTKELARQAQSMIQQLATYCARDVRVANVSAAEDSVSQRAVLMEKPDVVVGTPSRILSHLQQDSLKLRDSLELLVVDEADLLFSFGFEEELKSLLCHLPRIYQAFLMSATFNEDVQALKELILHNPVTLKLQESQLPGPDQLQQFQVVCETEEDKFLLLYALLKLSLIRGKSLLFVNTLERSYRLRLFLEQFSIPTCVLNGELPLRSRCHIISQFNQGFYDCVIATDAEVLGAPVKGKRRGRGPKGDKASDPEAGVARGIDFHHVSAVLNFDLPPTPEAYIHRAGRTARANNPGIVLTFVLPTEQFHLGKIEELLSGENRGPILLPYQFRMEEIEGFRYRCRDAMRSVTKQAIREARLKEIKEELLHSEKLKTYFEDNPRDLQLLRHDLPLHPAVVKPHLGHVPDYLVPPALRGLVRPHKKRKKLSSSCRKAKRAKSQNPLRSFKHKGKKFRPTAKPS

SEQ ID NO: 130 - protein, 483 aa, Homo sapiens
MSSKHRICSQEEVVIPCAYDSDSESVDLELSNLEIIKKGSSSIELTDLDIPDIPGLHCEPLSHSPRHLTQQDPLSEAIVEKLIQSIQKVFNGELKGELEKLKFLGDLSSLSQALPYDETAKSFIHSHIADIVHTLNVLVQEERPHSLSSSMRQEVFVTIADLSYQDVHLLLGSEDRAELFSLTIKSIITLPSVRTLTQIQEIMPNGTCNTECLYRQTFQAFSEMLQSLVVKDPHLENLDTIIKLPLRFQRLGHLVALMALLCGDPQEKVAEEAAEGIHSLLHITLRLKYITHDKKDQQNLKRALTKCREFLELHSSAAKCFYNCPFRIAQVFEGFLDSNELCQFIMTTFDTLKTLKHPCIQRSAGELLLTLAKNTESQFEKVPEIMGVICAQLSIISQPRVRQQIINTVSLFISRPKYTDIVLSFLLCHPVPYNRHLAEVWRMLSVELPSTTWILWRLLRKLQKCHNEPAQEKMAYVAVAVSP

SEQ ID NO: 131 - protein, 869 aa, Homo sapiens
MAGCRGSLCCCCRWCCCCGERETRTPEELTILGETQEEEDEILPRKDYESLDYDRCINDPYLEVLETMDNKKGRRYEAVKWMVVFAIGVCTGLVGLFVDFFVRLFTQLKFGVVQTSVEECSQKGCLALSLLELLGFNLTFVFLASLLVLIEPVAAGSGIPEVKCYLNGVKVPGIVRLRTLLCKVLGVLFSVAGGLFVGKEGPMIHSGSVVGAGLPQFQSISLRKIQFNFPYFRSDRDKRDFVSAGAAAGVAAAFGAPIGGTLFSLEEGSSFWNQGLTWKVLFCSMSATFTLNFFRSGIQFGSWGSFQLPGLLNFGEFKCSDSDKKCHLWTAMDLGFFVVMGVIGGLLGATFNCLNKRLAKYRMRNVHPKPKLVRVLESLLVSLVTTVVVFVASMVLGECRQMSSSSQIGNDSFQLQVTEDVNSSIKTFFCPNDTYNDMATLFFNPQESAILQLFHQDGTFSPVTLALFFVLYFLLACWTYGISVPSGLFVPSLLCGAAFGRLVANVLKSYIGLGHIYSGTFALIGAAAFLGGVVRMTISLTVILIESTNEITYGLPIMVTLMVAKWTGDFFNKGIYDIHVGLRGVPLLEWETEVEMDKLRASDIMEPNLTYVYPHTRIQSLVSILRTTVHHAFPVVTENRGNEKEFMKGNQLISNNIKFKKSSILTRAGEQRKRSQSMKSYPSSELRNMCDEHIASEEPAEKEDLLQQMLERRYTPYPNLYPDQSPSEDWTMEERFRPLTFHGLILRSQLVTLLVRGVCYSESQSSASQPRLSYAEMAEDYPRYPDIHDLDLTLLNPRMIVDVTPYMNPSPFTVSPNTHVSQVFNLFRTMGLRHLPVVNAVGEIVGIITRHNLTYEFLQARLRQHYQTI

SEQ ID NO: 132 - protein, 1007 aa, Homo sapiens
MSRRKQRKPQQLISDCEGPSASENGDASEEDHPQVCAKCCAQFTDPTEFLAHQNACSTDPPVMVIIGGQENPNNSSASSEPRPEGHNNPQVMDTEHSNPPDSGSSVPTDPTWGPERRGEESSGHFLVAATGTAAGGGGGLILASPKLGATPLPPESTPAPPPPPPPPPPPGVGSGHLNIPLILEELRVLQQRQIHQMQMTEQICRQVLLLGSLGQTVGAPASPSELPGTGTASSTKPLLPLFSPIKPVQTSKTLASSSSSSSSSSGAETPKQAFFHLYHPLGSQHPFSAGGVGRSHKPTPAPSPALPGSTDQLIASPHLAFPSTTGLLAAQCLGAARGLEATASPGLLKPKNGSGELSYGEVMGPLEKPGGRHKCRFCAKVFGSDSALQIHLRSHTGERPYKCNVCGNRFTTRGNLKVHFHRHREKYPHVQMNPHPVPEHLDYVITSSGLPYGMSVPPEKAEEEAATPGGGVERKPLVASTTALSATESLTLLSTSAGTATAPGLPAFNKFVLMKAVEPKNKADENTPPGSEGSAISGVAESSTATRMQLSKLVTSLPSWALLTNHFKSTGSFPFPYVLEPLGASPSETSKLQQLVEKIDRQGAVAVTSAASGAPTTSAPAPSSSASSGPNQCVICLRVLSCPRALRLHYGQHGGERPFKCKVCGRAFSTRGNLRAHFVGHKASPAARAQNSCPICQKKFTNAVTLQQHVRMHLGGQIPNGGTALPEGGGAAQENGSEQSTVSGARSFPQQQSQQPSPEEELSEEEEEEDEEEEEDVTDEDSLAGRGSESGGEKAISVRGDSEEASGAEEEVGTVAAAATAGKEMDSNEKTTQQSSLPPPPPPDSLDQPQPMEQGSSGVLGGKEEGGKPERSSSPASALTPEGEATSVTLVEELSLQEAMRKEPGESSSRKACEVCGQAFPSQAALEEHQKTHPKEGPLFTCVFCRQGFLERATLKKHMLLAHHQVQPFAPHGPQNIAALSLVPGCSPSITSTGLSPFPRKDDPTIP

SEQ ID NO: 133 - protein, 634 aa, Homo sapiens
MVRLVLPNPGLDARIPSLAELETIEQEEASSRPKWDNKAQYMLTCLGFCVGLGNVWRFPYLCQSHGGGAFMIPFLILLVLEGIPLLYLEFAIGQRLRRGSLGVWSSIHPALKGLGLASMLTSFMVGLYYNTIISWIMWYLFNSFQEPLPWSDCPLNENQTGYVDECARSSPVDYFWYRETLNISTSISDSGSIQWWMLLCLACAWSVLYMCTIRGIETTGKAVYITSTLPYVVLTIFLIRGLTLKGATNGIVFLFTPNVTELAQPDTWLDAGAQVFFSFSLAFGGLISFSSYNSVHNNCEKDSVIVSIINGFTSVYVAIVVYSVIGFRATQRYDDCFSTNILTLINGFDLPEGNVTQENFVDMQQRCNASDPAAYAQLVFQTCDINAFLSEAVEGTGLAFIVFTEAITKMPLSPLWSVLFFIMLFCLGLSSMFGNMEGVVVPLQDLRVIPPKWPKEVLTGLICLGTFLIGFIFTLNSGQYWLSLLDSYAGSIPLLIIAFCEMFSVVYVYGVDRFNKDIEFMIGHKPNIFWQVTWRVVSPLLMLIIFLFFFVVEVSQELTYSIWDPGYEEFPKSQKISYPNWVYVVVVIVAGVPSLTIPGYAIYKLIRNHCQKPGDHQGLVSTLSTASMNGDLKY

SEQ ID NO: 134 - protein, 1641 aa, Homo sapiens
MTESSMKKLASTLLDAITDKDPLVQEQVCSALCSLGEVRPVETLRACEEYLRQHDKLAHPYRAAVLRAMERVLSSRASELDKDTASTIILLASSEMTKTKDLVWDWQQAASGVLVAVGRQFISKVMEELLRRLHPGTLPHCAVLHTLASLSVANAFGVVPFLPSVLSSLLPVLGVAKQDTVRVAFCSALQRFSEGALEYLANLDRAPDPTVRKDAFATDIFSAYDVLFHQWLQSREAKLRLAVVEALGPMSHLLPSERLEEQLPKLLPGILALYKKHAETFYLSKSLGQILEAAVSVGSRTLETQLDALLAALHSQICVPVESSSPLVMSNQKEVLRCFTVLACSSPDRLLAFLLPRLDTSNERTRVGTLQVVRHVINSAAAQMEDKKPFILSSMRLPLLDTNSKVKRAVVQVISAMAHHGYLEQPGGEAMIEYIVQQCALPPEQEPEKPGPGSKDPKADSVRAISVRTLYLVSTTVDRMSHVLWPYLLQFLTPVRFTGALTPLCRSLVHLAQKRQEAGADAFLIQYDAHASLPSPYAVTGRLLVVSSSPYLGDGRGAAALRLLSVLHPNIHPLLGQHWETTVPLLLGYLDEHTEETLPQEEWEEKLLMFLRDTLAIISDNAWICQLSLELCRQLPCYDEAPQEKNFLYKCIGTTLGAASSKEVVRKHLQELLETARYQEEAEREGLACCFGICAISHLEDTLAQLEDFVRSEVFRKSIGILNIFKDRSENEVEKVKSALILCYGHVAARAPRELVLAKVESDILRNICQHFSTKVLGIKVETKDPALKLCLVQSVCMVSRAICSSTQAGSFHFTRKAELVAQMMEFIRAEPPDSLRTPIRKKAMLTCTYLVSVEPALDEQARADVIHGCLHSIMALLPEPKEEDGGCQKSLYLETLHALEDLLTSLLQRNMTPQGLQIMIEHLSPWIKSPRGHERARALGLSALLLRYFLEHLRVSALVPFHNLGLLIGLFSPRCADLWPATRQEAVDCVYSLLYLQLGYEGFSRDYRDDVAERLLSLKDGLVHPDPAILFHTCHSVGQIIAKRLPPDQLISLLLTMFEALGDPEKNCSRAATVMINCLLQERGGVLQEKVPEIVSVLRSKLQEAQGEHVLPAAQHSVYLLATQHCAAVVSSLLGSPLPLDSHTCMLWRALAVEPRLAAQVLGLLLEKMSRDVPFKESRAFLLGRTPDRVATLLPLSATCALFEVMSTPAAGPAVLELYPQLFVVLLLRVSCTVGVQLPRNLQAQERRGASPALATRNLEPCSSAVDTLRSMLLRSGSEDVVQRMDLEGGWELLRTSAGHEEGATRLARAMAEHAGPRLPLVLKTLACTHSSAYENQRVTTTAFLAELLNSNVANDLMLLDSLLESLAARQKDTCASVRRLVLRGLANLASGCPDKVRTHGPQLLTAMIGGLDDGDNPHSPVALEAMLGLARLVHLVESWDLRSGLLHVAIRIRPFFDSEKMEFRTASIRLFGHLNKVCHGDCEDVFLDQVVGGLAPLLLHLQDPQATVASACRFALRMCGPNLACEELSAAFQKHLQEGRALHFGEFLNTTCKHLMHHFPDLLGRLLTTCLFYFKSSWENVRAAAPLFTGFLVLHSEPRQQPQVDLDQLIAALQILLKDPAPEVRTRAAEALGRLVKLA

SEQ ID NO: 135 - protein, 438 aa, Homo sapiens
MPCTCTWRNWRQWIRPLVAVIYLVSIVVAVPLCVWELQKLEVGIHTKAWFIAGIFLLLTIPISLWVILQHLVHYTQPELQKPIIRILWMVPIYSLDSWIALKYPGIAIYVDTCRECYEAYVIYNFMGFLTNYLTNRYPNLVLILEAKDQQKHFPPLCCCPPWAMGEVLLFRCKLGVLQYTVVRPFTTIVALICELLGIYDEGNFSFSNAWTYLVIINNMSQLFAMYCLLLFYKVLKEELSPIQPVGKFLCVRLVVFVSFWQAVVIALLVKVGVISEKHTWEWQTVEAVATGLQDFIICIEMFLAAIAHHYTFSYKPYVQEAEEGSCFDSFLAMWDVSDIRDDISEQVRHVGRTVGGHPRKKLFPEDQDQNEHTSLLSSSSQDAISIASSMPPSPMGHYQGFGHTVTPQTTPTTAKISDEILSDTIGEKKEPSDKSVDS

SEQ ID NO: 136 - protein, 919 aa, Homo sapiens
MTGYTMLRNGGAGNGGQTCMLRWSNRIRLTWLSFTLFVILVFFPLIAHYYLTTLDEADEAGKRIFGPRVGNELCEVKHVLDLCRIRESVSEELLQLEAKRQELNSEIAKLNLKIEACKKSIENAKQDLLQLKNVISQTEHSYKELMAQNQPKLSLPIRLLPEKDDAGLPPPKATRGCRLHNCFDYSRCPLTSGFPVYVYDSDQFVFGSYLDPLVKQAFQATARANVYVTENADIACLYVILVGEMQEPVVLRPAELEKQLYSLPHWRTDGHNHVIINLSRKSDTQNLLYNVSTGRAMVAQSTFYTVQYRPGFDLVVSPLVHAMSEPNFMEIPPQVPVKRKYLFTFQGEKIESLRSSLQEARSFEEEMEGDPPADYDDRIIATLKAVQDSKLDQVLVEFTCKNQPKPSLPTEWALCGEREDRLELLKLSTFALIITPGDPRLVISSGCATRLFEALEVGAVPVVLGEQVQLPYQDMLQWNEAALVVPKPRVTEVHFLLRSLSDSDLLAMRRQGRFLWETYFSTADSIFNTVLAMIRTRIQIPAAPIREEAAAEIPHRSGKAAGTDPNMADNGDLDLGPVETEPPYASPRYLRNFTLTVTDFYRSWNCAPGPFHLFPHTPFDPVLPSEAKFLGSGTGFRPIGGGAGGSGKEFQAALGGNVPREQFTVVMLTYEREEVLMNSLERLNGLPYLNKVVVVWNSPKLPSEDLLWPDIGVPIMVVRTEKNSLNNRFLPWNEIETEAILSIDDDAHLRHDEIMFGFRVWREARDRIVGFPGRYHAWDIPHQSWLYNSNYSCELSMVLTGAAFFHKYYAYLYSYVMPQAIRDMVDEYINCEDIAMNFLVSHITRKPPIKVTSRWTFRCPGCPQALSHDDSHFHERHKCINFFVKVYGYMPLLYTQFRVDSVLFKTRLPHDKTKCFKFI

SEQ ID NO: 137 - protein, 217 aa, Homo sapiens
MALVQALVPREREPKLSILQMDRGDPQHSSHWCPEREKVKLLTLKPRETSKNILINFYRAFNLDKDVFIHQANHPLTVPSSVVMGDNGHTLAEDDKRPCFRVLPCYLERVSSGISISWISAPLPVGAMKHQLLCDLMDLITLSFWLAGQCMSLKATNMQHCKCSIATSDWAIELDRTDYKTLPSEYSILALLQVFAGKNCMDRVLLHVDVNYLKSLP

SEQ ID NO: 138 - protein, 992 aa, Homo sapiens
MKTETVPPFQETPAGSSCHLNNLLSSRKLMAVGVLLGWLLVIHLLVNVWLLCLLSALLVVLGGWLGSSLAGVASGRLHLERFIPLATCPPCPEAERQLEREINRTIQMIIRDFVLSWYRSVSQEPAFEEEMEAAMKGLVQELRRRMSVMDSHAVAQSVLTLCGCHLQSYIQAKEATAGKNGPVEPSHLWEAYCRATAPHPAVHSPSAEVTYTRGVVNLLLQGLVPKPHLETRTGRHVVVELITCNVILPLISRLSDPDWIHLVLVGIFSKARDPAPCPASAPEQPSVPTSLPLIAEVEQLPEGRASPVAAPVFLSYSEPEGSAGPSPEVEEGHEAVEGDLGGMCEERKVGNNSSHFLQPNLRGPLFLCEDSELESPLSELGKETIMLMTPGSFLSDRIQDALCALESSQALEPKDGEASEGAEAEEGPGTETETGLPVSTLNSCPEIHIDTADKEIEQGDVTASVTALLEGPEKTCPSRPSCLEKDLTNDVSSLDPTLPPVLLSSSPPGPLSSATFSFEPLSSPDGPVIIQNLRITGTITAREHSGTGFHPYTLYTVKYETALDGENSSGLQQLAYHTVNRRYREFLNLQTRLEEKPDLRKFIKNVKGPKKLFPDLPFGNMDSDRVEARKSLLESFLKQLCAIPEIANSEEVQEFLALNTDARIAFVKKPFMVSRIDKMVVSAIVDTLKTAFPRSEPQSPTEELSEAETESKPQTEGKKASKSRLRFSSSKISPALSVTEAQDKILYCLQEGSVESETLSMSAMESFIEKQTKLLEMQPTKAPEKDPEQPPKGRVDSCVSDAAVPAQDPSNSDPGTETELADTALDLLLLLLTEQWKWLCTENMQKFLRLIFGTLVQRWLEVQVANLTSPQRWVQYLRLLQESIWPGGVLPKFPRPVRTQEQKLAAEKQALQSLMGVLPDLVVEILGVNKCRLSWGLVLESLQQPLINRHLIYCLGDIILEFLDLSASVEESAATTSASDTPGNSKRMGVSS

SEQ ID NO: 139 - protein, 609 aa, Homo sapiens
MSGWESYYKTEGDEEAEEEQEENLEASGDYKYSGRDSLIFLVDASKAMFESQSEDELTPFDMSIQCIQSVYISKIISSDRDLLAVVFYGTEKDKNSVNFKNIYVLQELDNPGAKRILELDQFKGQQGQKRFQDMMGHGSDYSLSEVLWVCANLFSDVQFKMSHKRIMLFTNEDNPHGNDSAKASRARTKAGDLRDTGIFLDLMHLKKPGGFDISLFYRDIISIAEDEDLRVHFEESSKLEDLLRKVRAKETRKRALSRLKLKLNKDIVISVGIYNLVQKALKPPPIKLYRETNEPVKTKTRTFNTSTGGLLLPSDTKRSQIYGSRQIILEKEETEELKRFDDPGLMLMGFKPLVLLKKHHYLRPSLFVYPEESLVIGSSTLFSALLIKCLEKEVAALCRYTPRRNIPPYFVALVPQEEELDDQKIQVTPPGFQLVFLPFADDKRKMPFTEKIMATPEQVGKMKAIVEKLRFTYRSDSFENPVLQQHFRNLEALALDLMEPEQAVDLTLPKVEAMNKRLGSLVDEFKELVYPPDYNPEGKVTKRKHDNEGSGSKRPKVEYSEEELKTHISKGTLGKFTVPMLKEACRAYGLKSGLKKQELLEALTKHFQD

SEQ ID NO: 140 - protein, 2095 aa, Homo sapiens
MADADILSETFQLLIDSAKDFSKRLWGLVPFGLYLPAPPLYCPQPAILSEEDGDDLLLKAEKNNRQKVSGILQRVLLLFRAAQCSFPVAQWYILQLRWARKVMQKIRMKGSLPSLSPFPQSLLNYCKGGIAFFRPGAAGDHKLDEVSIRAIGCFRELCALCWMLHVRDKLSYSCRQYQKARENVKGEKDLEVEFDSCMIEHCLSAVEWAYRMLPFSRFFNMEELIQDIILSLIGELPPIRKVAEIFVKAFPYPEDVRVPLRDKYHSLHQRLRHCVVKGPQTEEMMSVVMHSIQKVRVKALKRVRRNIGSFEVNIWEPIEEEKPDEAPGVDRYSLGTSLSRSTLTELGDSVVHSDADTFSEALSVEEKSRINIYQRNAPNHMELTSIHKPTDKRKMCNQKENPTKKEDHEKLSQNTLPVIGVWEFERDDDEYIKFLDLFLSYILERDLPYSRDADIPFLTSFSGKLREHELNSLLFDVHTTLKRHQSKTKSQNVFRAGSCFVVAPESYESEKSSSLNDEYGMHLENQKLSSSVLVNQGIKPFLQYPSNEVNKNEGMSGLFGLKQRSIYKIQDDTREKCLIQRSSNHIFWTPKSIKTRRCIFKAIQCNDINPQEDLPLALNTFGSIGRLLEWMIRWSNRRLLCDSGITESSSEYSPVIRVKTSTAAILTSLWLLEQPYFATYKAKNAIIKMVENRDTGCQIGPNIERESKSDAGGSVAVATPGGTEERNGQNKSCQNILKMPTEAKNPDIKEINDDIISITHNTKKEFIDIDENLLEVEAFTEEEMDMHISDYEEDIEESVGGFRSPSLAICMMTLPQQLEEEFTEEVQCQREEPLETIMEEKSTEQKGMIEAFSHPGHTTPQSMQVDTSSEISSAQISTYKEKSSSVPLLISNGVNVASQPPAPTPQKTQRNEFTAQLPDCSESVRQMLQDEMFKLVQLQQINFMSLMQIVGSSFANLPDTQQLVQQSQSVHLGESQESNLRGCGDVEDSNKNLKERFFIKPQSMGENAREPRKNSPHCHEGTIPSGQNSTGNVQNVPHGSIPLCQLNGQPRKKGPIPSSQNLPSTSFYPAPAGNTHLYLLSTPSVVQKAPRLIPHAKTFSPGDGFPLLQFKSKQEFQPLFLHTGSIPQVPFRPLPQPREAWGLSDSFQPALPQRAAQTTPASHLNVSQYNTEARKKEVEQKTWAETVITEIPNHVNLDQYVGQENLTPQQDSSVFIKPEKLFDVKPGTLEISPHHSFGLPLLYLPLKPPNMFPSTSRASITVPSTPIQPIAEERKYPRLSLLHSHLSPENRCKKTQLIPLENLIAFKQSQQKLTHNLFEQGDAGHLQLLKVKIEPPEVRQGKDSKKRQRRRAEKELQEKRCEKLRRKPNVTFRPENSIINNDDSEIIKKPKEQQEHCGSHPLDDFDVPFEMLQDDNTSAGLHFMASVKKKAIGSQDASTNTDPEHEPLTAPQLLVPDVYLNLKLSSEMSEKPWSPSIPHTVTNLVGHTYINVIDIEANDLLQELPVREEPSNDNVIKQQSDHLAVPSSAELHYMAASVTNAVPPHNFKSQGLPKPEFRFKGQSTKSDSAEDYLLWKRLQGVSAACPAPSSAAHQLEHLSAKLQKIDEQLLAIQNIAENIEQDFPKPEMLDLHCDKIGPVDHIEFSSGPEFKKTLASKTISISEEVRFLTHMDEEDQSDKKETSEPEFSITENYSGQKTCVFPTADSAVSLSSSSDQNTTSPGMNSSDELCESVSVHPLQMTGLTDIADIIDDLIIKDGVSSEELGLTEQAMGTSRIQHYSGRHSQRTDKERREIQAWMKRKRKERMAKYLNELAEKRGQEHDPFCPRSNPLYMTSREIRLRQKMKHEKDRLLLSEHYSRRISQAYGLMNELLSESVQLPTLPQKPLPNKPSPTQSSSCQHCPSPRGENQHGHSFLINRPGKVKYMSKPSYIHKRKSFGQPQGSPWPHGTATFTIQKKAGGAKAAVRKATQSPVTFQKGSNAPCHSLQHTKKHGSAGLAPQTKQVCVEYEREETVVSPWTIPSEIHKILHESHNSLLQDLSPTEEEEPEHPFGVGGVDSVSESTGSILSKLDWNAIEDMVASVEDQGLSVHWALDL

SEQ ID NO: 141 - protein, 691 aa, Homo sapiens
MDQNQHLNKTAEAQPSENKKTRYCNGLKMFLAALSLSFIAKTLGAIIMKSSIIHIERRFEISSSLVGFIDGSFEIGNLLVIVFVSYFGSKLHRPKLIGIGCFIMGIGGVLTALPHFFMGYYRYSKETNINSSENSTSTLSTCLINQILSLNRASPEIVGKGCLKESGSYMWIYVFMGNMLRGIGETPIVPLGLSYIDDFAKEGHSSLYLGILNAIAMIGPIIGFTLGSLFSKMYVDIGYVDLSTIRITPTDSRWVGAWWLNFLVSGLFSIISSIPFFFLPQTPNKPQKERKASLSLHVLETNDEKDQTANLTNQGKNITKNVTGFFQSFKSILTNPLYVMFVLLTLLQVSSYIGAFTYVFKYVEQQYGQPSSKANILLGVITIPIFASGMFLGGYIIKKFKLNTVGIAKFSCFTAVMSLSFYLLYFFILCENKSVAGLTMTYDGNNPVTSHRDVPLSYCNSDCNCDESQWEPVCGNNGITYISPCLAGCKSSSGNKKPIVFYNCSCLEVTGLQNRNYSAHLGECPRDDACTRKFYFFVAIQVLNLFFSALGGTSHVMLIVKIVQPELKSLALGFHSMVIRALGGILAPIYFGALIDTTCIKWSTNNCGTRGSCRTYNSTSFSRVYLGLSSMLRVSSLVLYIILIYAMKKKYQEKDINASENGSVMDEANLESLNKNKHFVPSAGADSETHC

SEQ ID NO: 142 - protein, 419 aa, Homo sapiens
MGEKKPEPLDFVKDFQEYLTQQTHHVNMISGSVSGDKEAEALQGAGTDGDQNGLDHPSVEVSLDENSGMLVDGFERTFDGKLKCRYCNYASKGTARLIEHIRIHTGEKPHRCHLCPFASAYERHLEAHMRSHTGEKPYKCELCSFRCSDRSNLSHHRRRKHKMVPIKGTRSSLSSKKMWGVLQKKTSNLGYSRRALINLSPPSMVVQKPDYLNDFTHEIPNIQTDSYESMAKTTPTGGLPRDPQELMVDNPLNQLSTLAGQLSSLPPENQNPASPDVVPCPDEKPFMIQQPSTQAVVSAVSASIPQSSSPTSPEPRPSHSQRNYSPVAGPSSEPSAHTSTPSIGNSQPSTPAPALPVQDPQLLHHCQHCDMYFADNILYTIHMGCHGYENPFQCNICGCKCKNKYDFACHFARGQHNQH

SEQ ID NO: 143 - protein, 330 aa, Homo sapiens
MSQWHHPRSGWGRRRDFSGRSSAKKKGGNHIPERWKDYLPVGQRMPGTRFIAFKVPLQKSFEKKLAPEECFSPLDLFNKIREQNEELGLIIDLTYTQRYYKPEDLPETVPYLKIFTVGHQVPDDETIFKFKHAVNGFLKENKDNDKLIGVHCTHGLNRTGYLICRYLIDVEGVRPDDAIELFNRCRGHCLERQNYIEDLQNGPIRKNWNSSVPRSSDFEDSAHLMQPVHNKPVKQGPRYNLHQIQGHSAPRHFHTQTQSLQQSVRKFSENPHVYQRHHLPPPGPPGEDYSHRRYSWNVKPNASRAAQDRRRWYPYNYSRLSYPACWEWTQ

SEQ ID NO: 144 - protein, 979 aa, Homo sapiens
MALFAVFQTTFFLTLLSLRTYQSEVLAERLPLTPVSLKVSTNSTRQSLHLQWTVHNLPYHQELKMVFQIQISRIETSNVIWVGNYSTTVKWNQVLHWSWESELPLECATHFVRIKSLVDDAKFPEPNFWSNWSSWEEVSVQDSTGQDILFVFPKDKLVEEGTNVTICYVSRNIQNNVSCYLEGKQIHGEQLDPHVTAFNLNSVPFIRNKGTNIYCEASQGNVSEGMKGIVLFVSKVLEEPKDFSCETEDFKTLHCTWDPGTDTALGWSKQPSQSYTLFESFSGEKKLCTHKNWCNWQITQDSQETYNFTLIAENYLRKRSVNILFNLTHRVYLMNPFSVNFENVNATNAIMTWKVHSIRNNFTYLCQIELHGEGKMMQYNVSIKVNGEYFLSELEPATEYMARVRCADASHFWKWSEWSGQNFTTLEAAPSEAPDVWRIVSLEPGNHTVTLFWKPLSKLHANGKILFYNVVVENLDKPSSSELHSIPAPANSTKLILDRCSYQICVIANNSVGASPASVIVISADPENKEVEEERIAGTEGGFSLSWKPQPGDVIGYVVDWCDHTQDVLGDFQWKNVGPNTTSTVISTDAFRPGVRYDFRIYGLSTKRIACLLEKKTGYSQELAPSDNPHVLVDTLTSHSFTLSWKDYSTESQPGFIQGYHVYLKSKARQCHPRFEKAVLSDGSECCKYKIDNPEEKALIVDNLKPESFYEFFITPFTSAGEGPSATFTKVTTPDEHSSMLIHILLPMVFCVLLIMVMCYLKSQWIKETCYPDIPDPYKSSILSLIKFKENPHLIIMNVSDCIPDAIEVVSKPEGTKIQFLGTRKSLTETELTKPNYLYLLPTEKNHSGPGPCICFENLTYNQAASDSGSCGHVPVSPKAPSMLGLMTSPENVLKALEKNYMNSLGEIPAGETSLNYVSQLASPMFGDKDSLPTNPVEAPHCSEYKMQMAVSLRLALPPPTENSSLSSITLLDPGEHYC

SEQ ID NO: 145 - protein, 1489 aa, Homo sapiens
MGDAADPREMRKTFIVPAIKPFDHYDFSRAKIACNLAWLVAKAFGTENVPEELQEPFYTDQYDQEHIKPPVVNLLLSAELYCRAGSLILKSDAAKPLLGHDAVIQALAQKGLYVTDQEKLVTERDLHKKPIQMSAHLAMIDTLMMAYTVEMVSIEKVIACAQQYSAFFQATDLPYDIEDAVMYWINKVNEHLKDIMEQEQKLKEHHTVEAPGGQKSPSKWFWKLVPARYRKEQTLLKQLPCIPLVENLLKDGTDGCALAALIHFYCPDVVRLEDICLKETMSLADSLYNLQLIQEFCQEYLNQCCHFTLEDMLYAASSIKSNYLVFMAELFWWFEVVKPSFVQPRVVRPQGAEPVKDMPSIPVLNAAKRNVLDSSSDFPSSGEGATFTQSHHHLPSRYSRPQAHSSASGGIRRSSSMSYVDGFIGTWPKEKRSSVHGVSFDISFDKEDSVQRSTPNRGITRSISNEGLTLNNSHVSKHIRKNLSFKPINGEEEAESIEEELNIDSHSDLKSCVPLNTNELNSNENIHYKLPNGALQNRILLDEFGNQIETPSIEEALQIIHDTEKSPHTPQPDQIANGFFLHSQEMSILNSNIKLNQSSPDNVTDTKGALSPITDNTEVDTGIHVPSEDIPETMDEDSSLRDYTVSLDSDMDDASKFLQDYDIRTGNTREALSPCPSTVSTKSQPGSSASSSSGVKMTSFAEQKFRKLNHTDGKSSGSSSQKTTPEGSELNIPHVVAWAQIPEETGLPQGRDTTQLLASEMVHLRMKLEEKRRAIEAQKKKMEAAFTKQRQKMGRTAFLTVVKKKGDGISPLREEAAGAEDEKVYTDRAKEKESQKTDGQRSKSLADIKESMENPQAKWLKSPTTPIDPEKQWNLASPSEETLNEGEILEYTKSIEKLNSSLHFLQQEMQRLSLQQEMLMQMREQQSWVISPPQPSPQKQIRDFKPSKQAGLSSAIAPFSSDSPRPTHPSPQSSNRKSASFSVKSQRTPRPNELKITPLNRTLTPPRSVDSLPRLRRFSPSQVPIQTPSFVCFGDDGEPQLKESKPKEEVKKEELESKGTLEQRGHNPEEKEIKPFESTVSEVLSLPVTETVCLTPNEDQLNQPTEPPPKPVFPPTAPKNVNLIEVSLSDLKPPEKADVPVEKYDGESDKEQFDDDQKVCCGFFFKDDQKAENDMAMKRAALLEKRLRREKETQLRKQQLEAEMEHKKEETRRKTEEERQKKEDERARREFIRQEYMRRKQLKLMEDMDTVIKPRPQVVKQKKQRPKSIHRDHIESPKTPIKGPPVSSLSLASLNTGDNESVHSGKRTPRSESVEGFLSPSRCGSRNGEKDWENASTTSSVASGTEYTGPKLYKEPSAKSNKHIIQNALAHCCLAGKVNEGQKKKILEEMEKSDANNFLILFRDSGCQFRSLYTYCPETEEINKLTGIGPKSITKKMIEGLYKYNSDRKQFSHIPAKTLSASVDAITIHSHLWQTKRPVTPKKLLPTKA

SEQ ID NO: 146 - protein, 506 aa, Human papillomavirus type 23
MTLWLPASGKIYLPPTPPVARVQSTDEYVERTDIYYHATSDRLLTVGHPYFDVRSPDGSKIDVPKVSGNQFRAFRVTFPDPNKFALADMTIYDPDKYRLVWACAGLEIGRGQPLGVGSTGHPLFNKLRDAENSSERQEGTVDDRRNISFDPKQVQMFIIGCTPCLGEYWDTAPVCKDAGSQLGLCPPLELKNSVIEDGDMFDIGFGNINNKTLSFNRSDVSLDLVNEVCKYPDFLTMSNDVYGDACFFCARREQCYARHYFVRGGVVGDAIPDGAVQQDHKYYLPADQQNTLENSLYFPTVSGSLVTSDSQLFNRPFWLKRAQGHNNGILWNNQMFVTVADNTRNTNFSISVTNDSSLEKYDATKIREFTRHVEEYQLSFILQLCRIPLKAEVLTQINAMNSDILENWQLGFVPTPDNAVHDTYRYLASKATKCPDAVPDTQKEDPFGKYSFWNVDMTEKLSLDLDQYPLGRKFLFQIGVQRVRSGTKRPATRKVTKTVKRKKVQL

SEQ ID NO: 147 - protein, 377 aa, Homo sapiens
MASSEQAEQPSQPSSTPGSENVLPREPLIATAVKFLQNSRVRQSPLATRRAFLKKKGLTDEEIDMAFQQSGTAADEPSSLGPATQVVPVQPPHLISQPYSPAGSRWRDYGALAIIMAGIAFGFHQLYKKYLLPLILGGREDRKQLERMEAGLSELSGSVAQTVTQLQTTLASVQELLIQQQQKIQELAHELAAAKATTSTNWILESQNINELKSEINSLKGLLLNRRQFPPSPSAPKIPSWQIPVKSPSPSSPAAVNHHSSSDISPVSNESTSSSPGKEGHSPEGSTVTYHLLGPQEEGEGVVDVKGQVRMEVQGEEEKREDKEDEEDEEDDDVSHVDEEDCLGVQREDRRGGDGQINEQVEKLRRPEGASNESERD

SEQ ID NO: 148 - protein, 4471 aa, Homo sapiens
MVPEEVEVEIDEIPVLSEEGEEEEETYSQKVESVDKVRAKRVSLRTESLGQPLNREDEEMDKEISEKLPSKRTAKHIMEKMHLHMLCTPLPEEFLDQNVVFFLRNTKEAISEATDMKEAMEIMPETLEYGIINANVLHFLKNIICQVFLPALSFNQHRTSTTVGVTSGEVSNSSEHESDLPPMPGEAVEYHSIQLIRDEFLMNVQKFASNIQRTMQQLEGEIKLEMPIISVEGEVSDLAADPETVDILEQCVINWLNQISTAVEAQLKKTPQGKGPLAEIEFWRERNATLSALHEQTKLPIVRKVLDVIKESDSMLVANLQPVFTELFKFHTEASDNVRFLSTVERYFKNITHGSGFHVVLDTIPAMMSALRMVWIISRHYNKDERMIPLMERIAWEIAERVCRVVNLRTLFKENRASAQSKTLEARNTLRLWKKAYFDTRAKIEASGREDRWEFDRKRLFERTDYMATICQDLSDVLQVLEEFYNIFGPELKAVTGDPKRIDDVLCRVDGLVTPMENLTFDPFSIKSSQFWKYVMDEFKIEVLIDIINKIFVQNLENPPLYKNHPPVAGAIYWERSLFFRIKHTILRFQEVQEILDSDRGQEVKQKYLEVGRTMKEYEDRKYEQWMEVTEQVLPALMKKSLLTKSSIATEEPSTLERGAVFAINFSPALREIINETKYLEQLGFTVPELARNVALQEDKFLRYTAGIQRMLDHYHMLIGTLNDAESVLLKDHSQELLRVFRSGYKRLNWNSLGIGDYITGCKQAIGKFESLVHQIHKNADDISSRLTLIEAINLFKYPAAKSEEELPGVKEFFEHIERERASDVDHMVRWYLAIGPLLTKVEGLVVHTNTGKAPKLASYYKYWEKKIYEVLTKLILKNLQSFNSLILGNVPLFHTETILTAPEIILHPNTNEIDKMCFHCVRNCVEITKHFVRWMNGSCIECPPQKGEEEEVVIINFYNDISLNPQIIEQAVMIPQNVHRILINLMKYLQKWKRYRPLWKLDKAIVMEKFAAKKPPCVAYDEKLQFYSKIAYEVMRHPLIKDEHCIRLQLRHLANTVQENAKSWVISLGKLLNESAKEELYNLHEEMEHLAKNLRKIPNTLEDLKFVLATIAEIRSKSLVMELRYRDVQERYRTMAMYNLFPPDAEKELVDKIESIWSNLFNDSVNVEHALGDIKRTFTELTRGEIMNYRVQIEEFAKRFYSEGPGSVGDDLDKGVELLGVYERELARHEKSRQELANAEKLFDLPITMYPELLKVQKEMSGLRMIYELYEGLKVAKEEWSQTLWINLNVQILQEGIEGFLRALRKLPRPVRGLSVTYYLEAKMKAFKDSIPLLLDLKNEALRDRHWKELMEKTSVFFEMTETFTLENMFAMELHKHTDVLNEIVTAAIKEVAIEKAVKEILDTWENMKFTVVKYCKGTQERGYILGSVDEIIQSLDDNTFNLQSISGSRFVGPFLQTVHKWEKTLSLIGEVIEIWMLVQRKWMYLESIFIGGDIRSQLPEEAKKFDNIDKVFKRIMGETLKDPVIKRCCEAPNRLSDLQNVSEGLEKCQKSLNDYLDSKRNAFPRFFFISDDELLSILGSSDPLCVQEHMIKMYDNIASLRFNDGDSGEKLVSAMISAEGEVMEFRKIVRAEGRVEDWMTAVLNEMRRTNRLITKEAIFRYCEDRSRVDWMLLYQGMVVLAASQVWWTWEVEDVFHKAQKGEKQAMKNYGRKMHRQIDELVTRITMPLSKNDRKKYNTVLIIDVHARDIVDSFIRGSILEAREFDWESQLRFYWDREPDELNIRQCTGTFGYGYEYMGLNGRLVITPLTDRIYLTLTQALSMYLGGAPAGPAGTGKTETTKDLAKALGLLCVVTNCGEGMDYRAVGKIFSGLAQCGAWGCFDEFNRIDASVLSVISSQIQTIRNALIHQLTTFQFEGQEISLDSRMGIFITMNPGYAGRTELPESVKALFRPVVVIVPDLQQICEIMLFSEGFLEAKTLAKKMTVLYKLAREQLSKQYHYDFGLRALKSVLVMAGELKRGSSDLREDVVLMRALRDMNLPKFVFEDVPLFLGLISDLFPGLDCPRVRYPDFNDAVEQVLEENGYAVLPIQVDKVVQMFETMLTRHTTMVVGPTRGGKSVVINTLCQAQTKLGLTTKLYILNPKAVSVIELYGILDPTTRDWTDGVLSNIFREINKPTDKKERKYILFDGDVDALWVENMNSVMDDNRLLTLANGERIRLQAHCALLFEVGDLQYASPATVSRCGMVYVDPKNLKYRPYWKKWVNQIPNKVEQYNLNSLFEKYVPYLMDVIVEGIVDGRQAEKLKTIVPQTDLNMVTQLAKMLDALLEGEIEDLDLLECYFLEALYCSLGASLLEDGRMKFDEYIKRLASLSTVDTEGVWANPGELPGQLPTLYDFHFDNKRNQWVPWSKLVPEYIHAPERKFINILVHTVDTTRTTWILEQMVKIKQPVIFVGESGTSKTATTQNFLKNLSEETNIVLMVNFSSRTTSMDIQRNLEANVEKRTKDTYGPPMGKRLLVFMDDMNMPRVDEYGTQQPIALLKLLLEKGYLYDRGKELNCKSIRDLGFIAAMGKAGGGRNEVDPRFISLFSVFNVPFPSEESLHLIYSSILKGHTSTFHESIVAVSGKLTFCTLALYKNIVQDLPPTPSKFHYIFNLRDLSRVFNGLVLTNPERFQTVAQMVRVWRNECLRVFHDRLISETDKQLVQQHIGSLVVEHFKDDVEVVMRDPILFGDFQMALHEGEPRIYEDIQDYEAAKALFQEILEEYNESNTKMNLVLFDDALEHLTRVHRIIRMDRGHALLVGVGGSGKQSLSRLAAFTASCEVFEILLSRGYSENSFREDLKSLYLKLGIENKAMIFLFTDAHVAEEGFLELINNMLTSGIVPALFSEEEKESILSQIGQEALKQGMGPAKESVWQYFVNKSANNLHIVLGMSPVGDTLRTWCRNFPGMVNNTGIDWFMPWPPQALHAVAKSFLGYNPMIPAENIENVVKHVVLVHQSVDHYSQQFLQKLRRSNYVTPKNYLDFINTYSKLLDEKTQCNIAQCKRLDGGLDKLKEATIQLDELNQKLAEQKIVLAEKSAACEALLEEIAVNTAVAEEKKKLAEEKAMEIEEQNKVIAMEKAEAETTLAEVMPILEAAKLELQKLDKSDVTEIRSFAKPPKQVQTVCECILIMKGYKELNWKTAKGVMSDPNFLRSLMEIDFDSITQSQVKNIKGLLKTLNTTTEEMEAVSKAGLGMLKFVEAVMGYCDVFREIKPKREKVARLERNFYLTKRELERIQNELAAIQKELETLGAKYEAAILEKQKLQEEAEIMERRLIAADKLISGLGSENIRWLNDLDELMHRRVKLLGDCLLCAAFLSYEGAFTWEFRDEMVNRIWQNDILEREIPLSQPFRLESLLTDDVEISRWGSQGLPPDELSVQNGILTTRASRFPLCIDPQQQALNWIKRKEEKNNLRVASFNDPDFLKQLEMSIKYGTPFLFRDVDEYIDPVIDNVLEKNIKVSQGRQFIILGDKEVDYDSNFRLYLNTKLANPRYSPSVFGKAMVINYTVTLKGLEDQLLSVLVAYERRELEEQREHLIQETSENKNLLKDLEDSLLRELATSTGNMLDNVDLVHTLEETKSKATEVSEKLKLAEKTALDIDRLRDGYRPAARRGAILFFVLSEMALVNSMYQYSLIAFLEVFRLSLKKSLPDSILMKRLRNIMDTLTFSIYNHGCTGLFERHKLLFSFNMTIKIEQAEGRVPQEELDFFLKGNISLEKSKRKKPCAWLSDQGWEDIILLSEMFSDNFGQLPDDVENNQTVWQEWYDLDSLEQFPVPLGYDNNITPFQKLLILRCFRVDRVYRAVTDYVTVTMGEKYVQPPMISFEAIFEQSTPHSPIVFILSPGSDPATDLMKLAERSGFGGNRLKFLAMGQGQEKVALQLLETAVARGQWLMLQNCHLLVKWLKDLEKSLERITKPHPDFRLWLTTDPTKGFPIGILQKSLKVVTEPPNGLKLNMRATYFKISHEMLDQCPHPAFKPLVYVLAFFHAVVQERRKFGKIGWNVYYDFNESDFQVCMEILNTYLTKAFQQRDPRIPWGSLKYLIGEVMYGGRAIDSFDRRILTIYMDEYLGDFIFDTFQPFHFFRNKEVDYKIPVGDEKEKFVEAIEALPLANTPEVFGLHPNAEIGYYTQAARDMWAHLLELQPQTGESSSGISRDDYIGQVAKEIENKMPKVFDLDQVRKRLGTGLSPTSVVLLQELERFNKLVVRMTKSLAELQRALAGEVGMSNELDDVARSLFIGHIPNIWRRLAPDTLKSLGNWMVYFLRRFSQYMLWVTESEPSVMWLSGLHIPESYLTALVQATCRKNGWPLDRSTLFTQVTKFQDADEVNERAGQGCFVSGLYLEGADWDIEKGCLIKSKPKVLVVDLPILKIIPIEAHRLKLQNTFRTPVYTTSMRRNAMGVGLVFEADLFTTRHISHWVLQGVCLTLNSD

SEQ ID NO: 149 - protein, 534 aa, Homo sapiens
MTQAEIKLCSLLLQEHFGEIVEKIGVHLIRTGSQPLRVIAHDTGTSLDQVKKALCVLVQHNLVSYQVHKRGVVEYEAQCSRVLRMLRYPRYIYTTKTLYSDTGELIVEELLLNGKLTMSAVVKKVADRLTETMEDGKTMDYAEVSNTFVRLADTHFVQRCPSVPTTENSDPGPPPPAPTLVINEKDMYLVPKLSLIGKGKRRRSSDEDAAGEPKAKRPKYTTDNKEPIPDDGIYWQANLDRFHQHFRDQAIVSAVANRMDQTSSEIVRTMLRMSEITTSSSAPFTQPLSSNEIFRSLPVGYNISKQVLDQYLTLLADDPLEFVGKSGDSGGGMYVINLHKALASLATATLESVVQERFGSRCARIFRLVLQKKHIEQKQVEDFAMIPAKEAKDMLYKMLSENFMSLQEIPKTPDHAPSRTFYLYTVNILSAARMLLHRCYKSIANLIERRQFETKENKRLLEKSQRVEAIIASMQATGAEEAQLQEIEEMITAPERQQLETLKRNVNKLDASEIQVDETIFLLESYIECTMKRQ

SEQ ID NO: 150 - protein, 370 aa, Homo sapiens
MPTETLQTGSMVKPVSPAGTFTSAVPLRILNKGPDYFRRQAEPNPKRLSAVERLEADKAKYVKSQEVINAKQEPVKPAVLAKPPVCPAAKRALGSPTLKVFGNHAKTESGVQRENLKLEILKNIINSSEGSSSGSGHKHSSRNWPPHRSEATDLHRHSFAESLKVYPTQGRRSPQEGGSHVGRRLLEQSAESFLHVSHSSSDIRKVTSVKPLKAIPCSSSAPPLPPKPKIAAIASMKSPEADPVEPACGVSRRPSLQRSKSDLSDRYFRVDADVERFFNYCGLDPEELENLGMENFARANSDIISLNFRSASMISSDCEQSQDSNSDLRNDDSANDRVPYGISAIERNARIIKWLYSIKQARESQKVSHV

SEQ ID NO: 151 - protein, 865 aa, Homo sapiens
MLFTVSCSKMSSIVDRDDSSIFDGLVEEDDKDKAKRVSRNKSEKKRRDQFNVLIKELGSMLPGNARKMDKSTVLQKSIDFLRKHKEITAQSDASEIRQDWKPTFLSNEEFTQLMLEALDGFFLAIMTDGSIIYVSESVTSLLEHLPSDLVDQSVFNFIPEGEHSEVYKILSTHLLESDSLTPEYLKSKNQLEFCCHMLRGTVDPKEPSTYEYVRFIGNFKSLNSVPTSAHNGFEGTIQRTHRPSYEDRVCFVATVRLATPQFIKEMCTVEEPNEEFTSRHSLEWKFLFLDHRAPPIIGYLPFEVLGTSGYDYYHVDDLENLAKCHEHLMQYGKGKSCYYRFLTKGQQWIWLQTHYYITYHQWNSRPEFIVCTHTVVSYAEVRAERRRELGIEESLPDAAADKSQDSGSDNRINTVSLKEALERFDHSPTPSASSRSSRKSSHTAVSDPSSTPTKIPTDTSTPPRQHLPAHEKMAQRRSSFSSQSMNSQSVGPSLTQPVMSQAANLPVPQGMSQFQFSAQLGAMQHLKDQLEQRTRMIEANIHRQQEELRKIQEQLQMVHGQGLQMFLQQSNPGLNFGSVQLSSGNSSNIQQLTPINMQGQVVPTNQIQSGMNAGHIGTSQHLIQQQSLQSTSTQQSQQSVMSGHSQQTSLASQTQSTLTAPLYNTMVISQPAPGSMVQIPSSMPQNSTQSATVTTFTQDRQIRFSQGQQLVTKLVTAPVACGAVMVPSTMLMGQVVTAYPTFATQQQQAQTLSVTQQQPQQQQPQQQQPQQQQPQQQQQSSQEQQLPSVPQPSQAQLTQSPQQFLQTSRLLHGNPSTQLILSAAFPLQQSTFPPSHHQQHQSQQQQQLSRHRTDSLTDPSKVQPQ

SEQ ID NO: 152 - protein, 579 aa, Homo sapiens
MSAAIAALAASYGSGSGSESDSDSESSRCPLPAADSLMHLTKSPSSKPSLAVAVDSAPEVAVKEDLETGVHLDPAVKEVQYNPTYETMFAPEFGPENPFRTQQMAAPRNMLSGYAEPAHINDFMFEQQRRTFATYGYALDPSLDNHQVSAKYIGSVEEAEKNQGLTVFETGQKKTEKRKKFKENDASNIDGFLGPWAKYVDEKDVAKPSEEEQKELDEITAKRQKKGKQEEEKPGEEKTILHVKEMYDYQGRSYLHIPQDVGVNLRSTMPPEKCYLPKKQIHVWSGHTKGVSAVRLFPLSGHLLLSCSMDCKIKLWEVYGERRCLRTFIGHSKAVRDICFNTAGTQFLSAAYDRYLKLWDTETGQCISRFTNRKVPYCVKFNPDEDKQNLFVAGMSDKKIVQWDIRSGEIVQEYDRHLGAVNTIVFVDENRRFVSTSDDKSLRVWEWDIPVDFKYIAEPSMHSMPAVTLSPNGKWLACQSMDNQILIFGAQNRFRLNKKKIFKGHMVAGYACQVDFSPDMSYVISGDGNGKLNIWDWKTTKLYSRFKAHDKVCIGAVWHPHETSKVITCGWDGLIKLWD

SEQ ID NO: 153 - protein, 205 aa, Homo sapiens
MAAARPSLGRVLPGSSVLFLCDMQEKFRHNIAYFPQIVSVAARMLKVARLLEVPVMLTEQYPQGLGPTVPELGTEGLRPLAKTCFSMVPALQQELDSRPQLRSVLLCGIEAQACILNTTLDLLDRGLQVHVVVDACSSRSQVDRLVALARMRQSGAFLSTSEGLILQLVGDAVHPQFKEIQKLIKEPAPDSGLLGLFQGQNSLLH

SEQ ID NO: 154 - protein, 739 aa, Homo sapiens
MAPQKHGGGGGGGSGPSAGSGGGGFGGSAAVAAATASGGKSGGGSCGGGGSYSASSSSSAAAAAGAAVLPVKKPKMEHVQADHELFLQAFEKPTQIYRFLRTRNLIAPIFLHRTLTYMSHRNSRTNIKRKTFKVDDMLSKVEKMKGEQESHSLSAHLQLTFTGFFHKNDKPSPNSENEQNSVTLEVLLVKVCHKKRKDVSCPIRQVPTGKKQVPLNPDLNQTKPGNFPSLAVSSNEFEPSNSHMVKSYSLLFRVTRPGRREFNGMINGETNENIDVNEELPARRKRNREDGEKTFVAQMTVFDKNRRLQLLDGEYEVAMQEMEECPISKKRATWETILDGKRLPPFETFSQGPTLQFTLRWTGETNDKSTAPIAKPLATRNSESLHQENKPGSVKPTQTIAVKESLTTDLQTRKEKDTPNENRQKLRIFYQFLYNNNTRQQTEARDDLHCPWCTLNCRKLYSLLKHLKLCHSRFIFNYVYHPKGARIDVSINECYDGSYAGNPQDIHRQPGFAFSRNGPVKRTPITHILVCRPKRTKASMSEFLESEDGEVEQQRTYSSGHNRLYFHSDTCLPLRPQEMEVDSEDEKDPEWLREKTITQIEEFSDVNEGEKEVMKLWNLHVMKHGFIADNQMNHACMLFVENYGQKIIKKNLCRNFMLHLVSMHDFNLISIMSIDKAVTKLREMQQKLEKGESASPANEEITEEQNGTANGFSEINSKEKALETDSVSGVSKQSKKQKL

SEQ ID NO: 155 - protein, 381 aa, Homo sapiens
MRSHTITMTTTSVSSWPYSSHRMRFITNHSDQPPQNFSATPNVTTCPMDEKLLSTVLTTSYSVIFIVGLVGNIIALYVFLGIHRKRNSIQIYLLNVAIADLLLIFCLPFRIMYHINQNKWTLGVILCKVVGTLFYMNMYISIILLGFISLDRYIKINRSIQQRKAITTKQSIYVCCIVWMLALGGFLTMIILTLKKGGHNSTMCFHYRDKHNAKGEAIFNFILVVMFWLIFLLIILSYIKIGKNLLRISKRRSKFPNSGKYATTARNSFIVLIIFTICFVPYHAFRFIYISSQLNVSSCYWKEIVHKTNEIMLVLSSFNSCLDPVMYFLMSSNIRKIMCQLLFRRFQGEPSRSESTSEFKPGYSLHDTSVAVKIQSSSKST

SEQ ID NO: 156 - protein, 235 aa, Homo sapiens
MAVELGVLLVRPRPGTGLGRVMRTLLLVLWLATRGSALYFHIGETEKKCFIEEIPDETMVIGNYRTQLYDKQREEYQPATPGLGMFVEVKDPEDKVILARQYGSEGRFTFTSHTPGEHQICLHSNSTKFSLFAGGMLRVHLDIQVGEHANDYAEIAAKDKLSELQLRVRQLVEQVEQIQKEQNYQRWREERFRQTSESTNQRVLWWSILQTLILVAIGVWQMRHLKSFFEAKKLV

SEQ ID NO: 157 - protein, 1364 aa, Homo sapiens
MAELKVEAPASVDWQKRCLTLETQLFRFRLQASKIRELLADKMQELEQRLLEAEQRAENAETQVGVMEEKVKLSNLKNVDSEGSLHRKYQELLKAIKGKDELISQLEAQLEKQKQMRAEEAKTVQEKAAKIKEWVTLKLAKLEMENQHLKSHNQRLVEQVGSLQDALEAIQIAPSRKLLVPPYGAAEQDSVPSEPGIQPMGQDSGSQAQGLKAAVLAPSPGALQSKDSVSEAASPLEDSSSSTVHSGETVEAKPLQPHLGRESPPHQPCMKLLTFRCSSASWGEGLVTAQRGMLPGTKTSAREGGPGSSLTLPKVRAPGTPRDSIQLAKRHHSQPQVGHGHFGRVVNIETEAFSALHPSGLPELESRARSREEPEKMEMEEPPPAGKNEERESPKALGAELEEVELGNKPPTPPLHQFSSWESRIYAVATSGMRLSDMSPRSNTACCASSPPALVSPGSFSGLVYKNVTVPVYTALKGRATQISNMPFMDESSGSDDDCSSQASFRISVPSSESRKTSGLGSPRAIKRGVSMSSLSSEGDYAIPPDACSLDSDYSEPEHKLQRTSSYSTDGLGLGGESLEKSGYLLKMGSQVKTWKRRWFVLRQGQIMYYKSPSDVIRKPQGQVDLNSRCQIVRGEGSQTFQLISEKKTYYLTADSPSLLEEWIRVLQSLLKVQATGPPALLRGGTKPTVKGWLTKVKHGHSKVVWCALVGKIFYYYRSHEDKRPLGCLPVRDAHIEEVDRSCDSDEDYEAGGTRRLLSSHCTLVIHPTEHSPTYLLIGTKHEKDTWLYHLTVAAGGSSAKVGTAYEQLIGKLMDGEGDPDSPLWRHPMLCYSKDGLYASLTTLPSEALQTEALKLFKSCQLFINVPVEAASVDYHVSLAQTALQVCLVHPELQSEIYCQLMKQTSCRPPQKYSLMQCWQLLALCAPLFLPQHHFLWYVKQQLQRHADPRSETGQYATYCQRAVERTLRTGEREARPSRMEVVSILLRNPFHHSLPFSIPVHFTNGTYHVVGFDGSSTVDEFLQRLNQEIGMRKPSHSGFALFTDDPSGRDLEHCLQGSVKICDAISKWEQAMKELHPGKSEGGTRVVKLMYKNRLYFRSQVKGETDRERLLLASQTSREIVAGRFPINKELALEMAALMAQVEYGDLEKPALPGPGGTSPAKAQHLLQQVLDRFHPRRYRHGAPAEQLRHLADMLTTKWATLQGCSPPECIRIYLTVARKWPFFGAKLFAAQPAQLSSKENALVWIAVNEDGVSILDHNTMQVHITYPYSSVTTFGGCRDDFMLVIRSIPDKSSGKSHIEKLIFRMAAPKIAEATFIMASYMNHCTTTVNPPTNPPGACQLWELDGRQFFSSVSCATKGPTLL

SEQ ID NO: 158 - protein, 435 aa, Homo sapiens
MAQAVWSRLGRILWLACLLPWAPAGVAAGLYELNLTTDSPATTGAVVTISASLVAKDNGSLALPADAHLYRFHWIHTPLVLTGKMEKGLSSTIRVVGHVPGEFPVSVWVTAADCWMCQPVARGFVVLPITEFLVGDLVVTQNTSLPWPSSYLTKTVLKVSFLLHDPSNFLKTALFLYSWDFGDGTQMVTEDSVVYYNYSIIGTFTVKLKVVAEWEEVEPDATRAVKQKTGDFSASLKLQETLRGIQVLGPTLIQTFQKMTVTLNFLGSPPLTVCWRLKPECLPLEEGECHPVSVASTAYNLTHTFRDPGDYCFSIRAENIISKTHQYHKIQVWPSRIQPAVFAFPCATLITVMLAFIMYMTLRNATQQKDMVEVADFDFSPMSDKNPEPPSGVRCCCQMCCGPFLLETPSEYLEIVRENHGLLPPLYKSVKTYTV

SEQ ID NO: 159 - protein, 1079 aa, Homo sapiens
MVCSAAPLLLLATTLPLLGSPVAQASQPVSETGVRPREGLQRRQWGPLIGRDKAWNERIDRPFPACPIPLSSSFGRWPKGQTMWAQTSTLTLTEEELGQSQAGGESGSGQLLDQENGAGESALVSVYVHLDFPDKTWPPELSRTLTLPAASASSSPRPLLTGLRLTTECNVNHKGNFYCACLSGYQWNTSICLHYPPCQSLHNHQPCGCLVFSHPEPGYCQLLPPGSPVTCLPAVPGILNLNSQLQMPGDTLSLTLHLSQEATNLSWFLRHPGSPSPILLQPGTQVSVTSSHGQAALSVSNMSHHWAGEYMSCFEAQGFKWNLYEVVRVPLKATDVARLPYQLSISCATSPGFQLSCCIPSTNLAYTAAWSPGEGSKASSFNESGSQCFVLAVQRCPMADTTYACDLQSLGLAPLRVPISITIIQDGDITCPEDASVLTWNVTKAGHVAQAPCPESKRGIVRRLCGADGVWGPVHSSCTDARLLALFTRTKLLQAGQGSPAEEVPQILAQLPGQAAEASSPSDLLTLLSTMKYVAKVVAEARIQLDRRALKNLLIATDKVLDMDTRSLWTLAQARKPWAGSTLLLAVETLACSLCPQDHPFAFSLPNVLLQSQLFGPTFPADYSISFPTRPPLQAQIPRHSLAPLVRNGTEISITSLVLRKLDHLLPSNYGQGLGDSLYATPGLVLVISIMAGDRAFSQGEVIMDFGNTDGSPHCVFWDHSLFQGRGGWSKEGCQAQVASASPTAQCLCQHLTAFSVLMSPHTVPEEPALALLTQVGLGASILALLVCLGVYWLVWRVVVRNKISYFRHAALLNMVFCLLAADTCFLGAPFLSPGPRSPLCLAAAFLCHFLYLATFFWMLAQALVLAHQLLFVFHQLAKHRVLPLMVLLGYLCPLGLAGVTLGLYLPQGQYLREGECWLDGKGGALYTFVGPVLAIIGVNGLVLAMAMLKLLRPSLSEGPPAEKRQALLGVIKALLILTPIFGLTWGLGLATLLEEVSTVPHYIFTILNTLQGVFILLFGCLMDRKIQEALRKRFCRAQAPSSTISLVSCCLQILSCASKSMSEGIPWPSSEDMGTARS

SEQ ID NO: 160 - protein, 1461 aa, Homo sapiens
MAAGGGGGSSKASSSSASSAGALESSLDRKFQSVTNTMESIQGLSSWCIENKKHHSTIVYHWMKWLRRSAYPHRLNLFYLANDVIQNCKRKNAIIFRESFADVLPEAAALVKDPSVSKSVERIFKIWEDRNVYPEEMIVALREALSTTFKTQKQLKENLNKQPNKQWKKSQTSTNPKAALKSKIVAEFRSQALIEELLLYKRSEDQIELKEKQLSTMRVDVCSTETLKCLKDKTGGKKFSKEFEEASSKLEEFVNGLDKQVKNGPSLTEALENAGIFYEAQYKEVKVVANAYKTFANRVNNLKKKLDQLKSTLPDPEESPVPSPSMDAPSPTGSESPFQGMGGEESQSPTMESEKSATPEPVTDNRDVEDMELSDVEDDGSKIIVEDRKEKPAEKSAVSTSVPTKPTENISKASSCTPVPVTMTATPPLPKPVNTSLSPSPALALPNLANVDLAKISSILSSLTSVMKNTGVSPASRPSPGTPTSPSNLTSGLKTPAPATTTSHNPLANILSKVEITPESILSALSKTQTQSAPALQGLSSLLQSVTGNPVPASEAASQSTSASPANTTVSTIKGRNLPSSAQPFIPKSFNYSPNSSTSEVSSTSASKASIGQSPGLPSTTFKLPSNSLGFTATHNTSPAAPPTEVTICQSSEVSKPKLESESTSPSLEMKIHNFLKGNPGFSGLNLNIPILSSLGSSAPSESHPSDFQRGPTSTSIDNIDGTPVRDERSGTPTQDEMMDKPTSSSVDTMSLLSKIISPGSSTPSSTRSPPPGRDESYPRELSNSVSTYRPFGLGSESPYKQPSDGMERPSSLMDSSQEKFYPDTSFQEDEDYRDFEYSGPPPSAMMNLEKKPAKSILKSSKLSDTTEYQPILSSYSHRAQEFGVKSAFPPSVRALLDSSENCDRLSSSPGLFGAFSVRGNEPGSDRSPSPSKNDSFFTPDSNHNSLSQSTTGHLSLPQKQYPDSPHPVPHRSLFSPQNTLAAPTGHPPTSGVEKVLASTISTTSTIEFKNMLKNASRKPSDDKHFGQAPSKGTPSDGVSLSNLTQPSLTATDQQQQEEHYRIETRVSSSCLDLPDSTEEKGAPIETLGYHSASNRRMSGEPIQTVESIRVPGKGNRGHGREASRVGWFDLSTSGSSFDNGPSSASELASLGGGGSGGLTGFKTAPYKERAPQFQESVGSFRSNSFNSTFEHHLPPSPLEHGTPFQREPVGPSSAPPVPPKDHGGIFSRDAPTHLPSVDLSNPFTKEAALAHAAPPPPPGEHSGIPFPTPPPPPPPGEHSSSGGSGVPFSTPPPPPPPVDHSGVVPFPAPPLAEHGVAGAVAVFPKDHSSLLQGTLAEHFGVLPGPRDHGGPTQRDLNGPGLSRVRESLTLPSHSLEHLGPPHGGGGGGGSNSSSGPPLGPSHRDTISRSGIILRSPRPDFRPREPFLSRDPFHSLKRPRPPFARGPPFFAPKRPFFPPRY

SEQ ID NO: 161 - protein, 643 aa, Homo sapiens [sequence omitted]

SEQ ID NO: 162 - protein, 1057 aa, Homo sapiens
MLCWGNASFGQLGLGGIDEEIVLEPRKSDFFINKRVRDVGCGLRHTVFVLDDGTVYTCGCNDLGQLGHEKSRKKPEQVVALDAQNIVAVSCGEAHTLALNDKGQVYAWGLDSDGQLGLVGSEECIRVPRNIKSLSDIQIVQVACGYYHSLALSKASEVFCWGQNKYGQLGLGTDCKKQTSPQLLKSLLGIPFMQVAAGGAHSFVLTLSGAIFGWGRNKFGQLGLNDENDRYVPNLLKSLRSQKIVYICCGEDHTAALTKEGGVFTFGAGGYGQLGHNSTSHEINPRKVFELMGSIVTEIACGRQHTSAFVPSSGRIYSFGLGGNGQLGTGSTSNRKSPFTVKGNWYPYNGQCLPDIDSEEYFCVKRIFSGGDQSFSHYSSPQNCGPPDDFRCPNPTKQIWTVNEALIQKWLSYPSGRFPVEIANEIDGTFSSSGCLNGSFLAVSNDDHYRTGTRFSGVDMNAARLLFHKLIQPDHPQISQQVAASLEKNLIPKLTSSLPDVEALRFYLTLPECPLMSDSNNFTTIAIPFGTALVNLEKAPLKVLENWWSVLEPPLFLKIVELFKEVVVHLLKLYKIGIPPSERRIFNSFLHTALKVLEILHRVNEKMGQIIQYDKFYIHEVQELIDIRNDYINWVQQQAYGMDVNHGLTELADIPVTICTYPFVFDAQAKTTLLQTDAVLQMQMAIDQAHRQNVSSLFLPVIESVNPCLILVVRRENIVGDAMEVLRKTKNIDYKKPLKVIFVGEDAVDAGGVRKEFFLLIMRELLDPKYGMFRYYEDSRLIWFSDKTFEDSDLFHLIGVICGLAIYNCTIVDLHFPLALYKKLLKKKPSLDDLKELMPDVGRSMQQLLDYPEDDIEETFCLNFTITVENFGATEVKELVLNGADTAVNKQNRQEFVDAYVDYIFNKSVASLFDAFHAGFHKVCGGKVLLLFQPNELQAMVIGNTNYDWKELEKNTEYKGEYWAEHPTIKIFWEVFHELPLEKKKQFLLFLTGSDRIPILGMKSLKLVIQSTGGGEEYLPVSHTCFNLLDLPKYTEKETLRSKLIQAIDHNEGFSLI

SEQ ID NO: 163 - protein, 2774 aa, Homo sapiens
MDVKDRRHRSLTRGRCGKECRYTSSSLDSEDCRVPTQKSYSSSETLKAYDHDSRMHYGNRVTDLVHRESDEFSRQGTNFTLAELGICEPSPHRSGYCSDMGILHQGYSLSTGSDADSDTEGGMSPEHAIRLWGRGIKSRRSSGLSSRENSALTLTDSDNENKSDDDNGRPIPPTSSSSLLPSAQLPSSHNPPPVSCQMPLLDSNTSHQIMDTNPDEEFSPNSYLLRACSGPQQASSSGPPNHHSQSTLRPPLPPPHNHTLSHHHSSANSLNRNSLTNRRSQIHAPAPAPNDLATTPESVQLQDSWVLNSNVPLETRHFLFKTSSGSTPLFSSSSPGYPLTSGTVYTPPPRLLPRNTFSRKAFKLKKPSKYCSWKCAALSAIAAALLLAILLAYFIAMHLLGLNWQLQPADGHTFNNGVRTGLPGNDDVATVPSGGKVPWSLKNSSIDSGEAEVGRRVTQEVPPGVFWRSQIHISQPQFLKFNISLGKDALFGVYIRRGLPPSHAQYDFMERLDGKEKWSVVESPRERRSIQTLVQNEAVFVQYLDVGLWHLAFYNDGKDKEMVSFNTVVLDSVQDCPRNCHGNGECVSGLCHCFPGFLGADCAKAACPVLCSGNGQYSKGTCQCYSGWKGAECDVPMNQCIDPSCGGHGSCIDGNCVCSAGYKGEHCEEVDCLDPTCSSHGVCVNGECLCSPGWGGLNCELARVQCPDQCSGHGTYLPDTGLCSCDPNWMGPDCSVEVCSVDCGTHGVCIGGACRCEEGWTGAACDQRVCHPRCIEHGTCKDGKCECREGWNGEHCTIGRQTAGTETDGCPDLCNGNGRCTLGQNSWQCVCQTGWRGPGCNVAMETSCADNKDNEGDGLVDCLDPDCCLQSACQNSLLCRGSRDPLDIIQQGQTDWPAVKSFYDRIKLLAGKDSTHIIPGENPFNSSLVSLIRGQVVTTDGTPLVGVNVSFVKYPKYGYTITRQDGTFDLIANGGASLTLHFERAPFMSQERTVWLPWNSFYAMDTLVMKTEENSIPSCDLSGFVRPDPIIISSPLSTFFSAAPGQNPIVPETQVLHEEIELPGSNVKLRYLSSRTAGYKSLLKITMTQSTVPLNLIRVHLMVAVEGHLFQKSFQASPNLAYTFIWDKTDAYGQRVYGLSDAVVSVGFEYETCPSLILWEKRTALLQGFELDPSNLGGWSLDKHHILNVKSGILHKGTGENQFLTQQPAIITSIMGNGRRRSISCPSCNGLAEGNKLLAPVALAVGIDGSLYVGDFNYIRRIFPSRNVTSILELRNKEFKHSNNPAHKYYLAVDPVSGSLYVSDTNSRRIYRVKSLSGTKDLAGNSEVVAGTGEQCLPFDEARCGDGGKAIDATLMSPRGIAVDKNGLMYFVDATMIRKVDQNGIISTLLGSNDLTAVRPLSCDSSMDVAQVRLEWPTDLAVNPMDNSLYVLENNVILRITENHQVSIIAGRPMHCQVPGIDYSLSKLAIHSALESASAIAISHTGVLYITETDEKKINRLRQVTTNGEICLLAGAASDCDCKNDVNCNCYSGDDAYATDAILNSPSSLAVAPDGTIYIADLGNIRIRAVSKNKPVLNAFNQYEAASPGEQELYVFNADGIHQYTVSLVTGEYLYNFTYSTDNDVTELIDNNGNSLKIRRDSSGMPRHLLMPDNQIITLTVGTNGGLKVVSTQNLELGLMTYDGNTGLLATKSDETGWTTFYDYDHEGRLTNVTRPTGVVTSLHREMEKSITIDIENSNRDDDVTVITNLSSVEASYTVVQDQVRNSYQLCNNGTLRVMYANGMGISFHSEPHVLAGTITPTIGRCNISLPMENGLNSIEWRLRKEQIKGKVTIFGRKLRVHGRNLLSIDYDRNIRTEKIYDDHRKFTLRIIYDQVGRPFLWLPSSGLAAVNVSYFFNGRLAGLQRGAMSERTDIDKQGRIVSRMFADGKVWSYSYLDKSMVLLLQSQRQYIFEYDSSDRLLAVTMPSVARHSMSTHTSIGYIRNIYNPPESNASVIFDYSDDGRILKTSFLGTGRQVFYKYGKLSKLSEIVYDSTAVTFGYDETTGVLKMVNLQSGGFSCTIRYRKIGPLVDKQIYRFSEEGMVNARFDYTYHDNSFRIASIKPVISETPLPVDLYRYDEISGKVEHFGKFGVIYYDINQIITTAVMTLSKHFDTHGRIKEVQYEMFRSLMYWMTVQYDSMGRVIKRELKLGPYANTTKYTYDYDGDGQLQSVAVNDRPTWRYSYDLNGNLHLLNPGNSVRLMPLRYDLRDRITRLGDVQYKIDDDGYLCQRGSDIFEYNSKGLLTRAYNKASGWSVQYRYDGVGRRASYKTNLGHHLQYFYSDLHNPTRITHVYNHSNSEITSLYYDLQGHLFAMESSSGEEYYVASDNTGTPLAVFSINGPMIKQLQYTAYGEIYYDSNPDFQMVIGFHGGLYDPLTKLVHFTQRDYDVLAGRWTSPDYTMWKNVGKEPAPFNLYMFKSNNPLSSELDLKNYVTDVKSWLVMFGFQLSNIIPGFPRAKMYFVPPPYELSESQASENGQLITGVQQTTERHNQAFMALEGQVITKKLHASIREKAGHWFATTTPIIGKGIMFAIKEGRVTTGVSSIASEDSRKVASVLNNAYYLDKMHYSIEGKDTHYFVKIGSADGDLVTLGTTIGRKVLESGVNVTVSQPTLLVNGRTRRFTNIEFQYSTLLLSIRYGLTPDTLDEEKARVLDQARQRALGTAWAKEQQKARDGREGSRLWTEGEKQQLLSTGRVQGYEGYYVLPVEQYPELADSSSNIQFLRQNEMGKR

SEQ ID NO: 164 - protein, 341 aa, Homo sapiens
MTMESGAENQQSGDAAVTEAENQQMTVQAQPQIATLAQVSMPAAHATSSAPTVTLVQLPNGQTVQVHGVIQAAQPSVIQSPQVQTVQSSCKDLKRLFSGTQISTIAESEDSQESVDSVTDSQKRREILSRRPSYRKILNDLSSDAPGVPRIEEEKSEEETSAPAITTVTVPTPIYQTSSGQYIAITQGGAIQLANNGTDGVQGLQTLTMTNAAATQPGTTILQYAQTTDGQQILVPSNQVVVQAASGDVQTYQIRTAPTSTIAPGVVMASSPALPTQPAEEAARKREVRLMKNREAARECRRKKKEYVKCLENRVAVLENQNKTLIEELKALKDLYCHKSD

SEQ ID NO: 165 - protein, 1057 aa, Homo sapiens; identical to SEQ ID NO: 162

SEQ ID NO: 166 - protein, 8797 aa, Homo sapiens
MATSRGASRCPRDIANVMQRLQDEQEIVQKRTFTKWINSHLAKRKPPMVVDDLFEDMKDGVKLLALLEVLSGQKLPCEQGRRMKRIHAVANIGTALKFLEGRKIKLVNINSTDIADGRPSIVLGLMWTIILYFQIEELTSNLPQLQSLSSSASSVDSIVSSETPSPPSKRKVTTKIQGNAKKALLKWVQYTAGKQTGIEVKDFGKSWRSGVAFHSVIHAIRPELVDLETVKGRSNRENLEDAFTIAETELGIPRLLDPEDVDVDKPDEKSIMTYVAQFLKHYPDIHNASTDGQEDDEILPGFPSFANSVQNFKREDRVIFKEMKVWIEQFERDLTRAQMVESNLQDKYQSFKHFRVQYEMKRKQIEHLIQPLHRDGKLSLDQALVKQSWDRVTSRLFDWHIQLDKSLPAPLGTIGAWLYRAEVALREEITVQQVHEETANTIQRKLEQHKDLLQNTDAHKRAFHEIYRTRSVNGIPVPPDQLEDMAERFHFVSSTSELHLMKMEFLELKYRLLSLLVLAESKLKSWIIKYGRRESVEQLLQNYVSFIENSKFFEQYEVTYQILKQTAEMYVKADGSVEEAENVMKFMNETTAQWRNLSVEVRSVRSMLEEVISNWDRYGNTVASLQAWLEDAEKMLNQSENAKKDFFRNLPHWIQQHTAMNDAGNFLIETCDEMVSRDLKQQLLLLNGRWRELFMEVKQYAQADEMDRMKKEYTDCVVTLSAFATEAHKKLSEPLEVSFMNVKLLIQDLEDIEQRVPVMDAQYKIITKTAHLITKESPQEEGKEMFATMSKLKEQLTKVKECYSPLLYESQQLLIPLEELEKQMTSFYDSLGKINEIITVLEREAQSSALFKQKHQELLACQENCKKTLTLIEKGSQSVQKFVTLSNVLKHFDQTRLQRQIADIHVAFQSMVKKTGDWKKHVETNSRLMKKFEESRAELEKVLRIAQEGLEEKGDPEELLRRHTEFFSQLDQRVLNAFLKACDELTDILPEQEQQGLQEAVRKLHKQWKDLQGEAPYHLLHLKIDVEKNRFLASVEECRTELDRETKLMPQEGSEKIIKEHRVFFSDKGPHHLCEKRLQLIEELCVKLPVRDPVRDTPGTCHVTLKELRAAIDSTYRKLMEDPDKWKDYTSRFSEFSSWISTNETQLKGIKGEAIDTANHGEVKRAVEEIRNGVTKRGETLSWLKSRLKVLTEVSSENEAQKQGDELAKLSSSFKALVTLLSEVEKMLSNFGDCVQYKEIVKNSLEELISGSKEVQEQAEKILDTENLFEAQQLLLHHQQKTKRISAKKRDVQQQIAQAQQGEGGLPDRGHEELRKLESTLDGLERSRERQERRIQVTLRKWERFETNKETVVRYLFQTGSSHERFLSFSSLESLSSELEQTKEFSKRTESIAVQAENLVKEASEIPLGPQNKQLLQQQAKSIKEQVKKLEDTLEEDIKTMEMVKTKWDHFGSNFETLSVWITEKEKELNALETSSSAMDMQISQIKVTIQEIESKLSSIVGLEEEAQSFAQFVTTGESARIKAKLTQIRRYGEELREHAQCLEGTILGHLSQQQKFEENLRKIQQSVSEFEDKLAVPIKICSSATETYKVLQEHMDLCQALESLSSAITAFSASARKVVNRDSCVQEAAALQQQYEDILRRAKERQTALENLLAHWQRLEKELSSFLTWLERGEAKASSPEMDISADRVKVEGELQLIQALQNEVVSQASFYSKLLQLKESLFSVASKDDVKMMKLHLEQLDERWRDLPQIINKRINFLQSVVAEHQQFDELLLSFSVWIKLFLSELQTTSEISIMDHQVALTRHKDHAAEVESKKGELQSLQGHLAKLGSLGRAEDLHLLQGKAEDCFQLFEEASQVVERRQLALSHLAEFLQSHASLSGILRQLRQTVEATNSMNKNESDLIEKDLNDALQNAKALESAAVSLDGILSKAQYHLKIGSSEQRTSCRATADQLCGEVERIQNLLGTKQSEADALAVLKKAFQDQKEELLKSIEDIEERTDKERLKEPTRQALQQRLRVFNQLEDELNSHEHELCWLKDKAKQIAQKDVAFAPEVDREINRLEVTWDDTKRLIHENQGQCCGLIDLMREYQNLKSAVSKVLENASSVIVTRTTIKDQEDLKWAFSKHETAKNKMNYKQKDLDNFTSKGKHLLSELKKIHSSDFSLVKTDMESTVDKWLDVSEKLEENMDRLRVSLSIWDDVLSTRDEIEGWSNNCVPQMAENISNLDNHLRAEELLKEFESEVKNKALRLEELHSKVNDLKELTKNLETPPDLQFIEADLMQKLEHAKEITEVAKGTLKDFTAQSTQVEKFINDITTWFTKVEESLMNCAQNETCEALKKVKDIQKELQSQQSNISSTQENLNSLCRKYHSAELESLGRAMTGLIKKHEAVSQLCSKTQASLQESLEKHFSESMQEFQEWFLGAKAAAKESSDRTGDSKVLEAKLHDLQNILDSVSDGQSKLDAVTQEGQTLYAHLSKQIVSSIQEQITKANEEFQAFLKQCLKDKQALQDCASELGSFEDQHRKLNLWIHEMEERFNTENLGESKQHIPEKKNEVHKVEMFLGELLAARESLDKLSQRGQLLSEEGHGAGQEGRLCSQLLTSHQNLLRMTKEKLRSCQVALQEHEALEEALQSMWFWVKAIQDRLACAESTLGSKDTLEKRLSQIQDILLMKGEGEVKLNMAIGKGEQALRSSNKEGQRVIQTQLETLKEVWADIMSSSVHAQSTLESVISQWNDYVERKNQLEQWMESVDQKIEHPLQPQPGLKEKFVLLDHLQSILSEAEDHTRALHRLIAKSRELYEKTEDESFKDTAQEELKTQFNDIMTVAKEKMRKVEEIVKDHLMYLDAVHEFTDWLHSAKEELHRWSDMSGDSSATQKKLSKIKELIDSREIGASRLSRVESLAPEVKQNTTASGCELMHTEMQALRADWKQWEDSVFQTQSCLENLVSQMALSEQEFSGQVAQLEQALEQFSALLKTWAQQLTLLEGKNTDEEIVECWHKGQEILDALQKAEPRTEDLKSQLNELCRFSRDLSTYSGKVSGLIKEYNCLCLQASKGCQNKEQILQQRFRKAFRDFQQWLVNAKITTAKCFDIPQNISEVSTSLQKIQEFLSESENGQHKLNMMLSKGELLSTLLTKEKAKGIQAKVTAAKEDWKNFHSNLHQKESALENLKIQMKDFEVSAEPIQDWLSKTEKMVHESSNRLYDLPAKRREQQKLQSVLEEIHCYEPQLNRLKEKAQQLWEGQAASKSFRHRVSQLSSQYLALSNLTKEKVSRLDRIVAEHNQFSLGIKELQDWMTDAIHMLDSYCHPTSDKSVLDSRTLKLEALLSVKQEKEIQMKMIVTRGESVLQNTSPEGIPTIQQQLQSVKDMWASLLSAGIRCKSQLEGALSKWTSYQDGVRQFSGWMDSMEANLNESERQHAELRDKTTMLGKAKLLNEEVLSYSSLLETIEVKGAGMTEHYVTQLELQDLQERYRAIQERAKEAVTKSEKLVRLHQEYQRDLKAFEVWLGQEQEKLDQYSVLEGDAHTHETTLRDLQELQVHCAEGQALLNSVLHTREDVIPSGIPQAEDRALESLRQDWQAYQHRLSETRTQFNNVVNKLRLMEQKFQQVDEWLKTAEEKVSPRTRRQSNRATKEIQLHQMKKWHEEVTAYRDEVEEVGARAQEILDESHVNSRMGCQATQLTSRYQALLLQVLEQIKFLEEEIQSLEESESSLSSYSDWYGSTHKNFKNVATKIDKVDTVMMGKKLKTLEVLLKDMEKGHSLLKSAREKGERAVKYLEEGEAERLRKEIHDHMEQLKELTSTVRKEHMTLEKGLHLAKEFSDKCKALTQWIAEYQEILHVPEEPKMELYEKKAQLSKYKSLQQTVLSHEPSVKSVREKGEALLELVQDVTLKDKIDQLQSDYQDLCSIGKEHVFSLEAKVKDHEDYNSELQEVEKWLLQMSGRLVAPDLLETSSLETITQQLAHHKAMMEEIAGFEDRLNNLQMKGDTLIGQCADHLQAKLKQNVHAHLQGTKDSYSAICSTAQRMYQSLEHELQKHVSRQDTLQQCQAWLSAVQPDLEPSPQPPLSRAEAIKQVKHFRALQEQARTYLDLLCSMCDLSNASVKTTAKDIQQTEQTIEQKLVQAQNLTQGWEEIKHLKSELWIYLQDADQQLQNMKRRHSELELNIAQNMVSQVKDFVKKLQSKQASVNTIIEKVNKLTKKEESPEHKEINHLNDQWLDLCRQSNNLCLQREEDLQRTRDYHDCMNVVEVFLEKFTTEWDNLARSDAESTAVHLEALKKLALALQERKYAIEDLKDQKQKMIEHLNLDDKELVKEQTSHLEQRWFQLEDLIKRKIQVSVTNLEELNVVQSRFQELMEWAEEQQPNIAEALKQSPPPDMAQNLLMDHLAICSELEAKQMLLKSLIKDADRVMADLGLNERQVIQKALSDAQSHVNCLSDLVGQRRKYLNKALSEKTQFLMAVFQATSQIQQHERKIMFREHICLLPDDVSKQVKTCKSAQASLKTYQNEVTGLWAQGRELMKEVTEQEKSEVLGKLQELQSVYDSVLQKCSHRLQELEKNLVSRKHFKEDFDKACHWLKQADIVTFPEINLMNESSELHTQLAKYQNILEQSPEYENLLLTLQRTGQTILPSLNEVDHSYLSEKLNALPRQFNVIVALAKDKFYKVQEAILARKEYASLIELTTQSLSELEAQFLRMSKVPTDLAVEEALSLQDGCRAILDEVAGLGEAVDELNQKKEGFRSTGQPWQPDKMLHLVTLYHRLKRQTEQRVSLLEDTTSAYQEHEKMCQQLERQLKSVKEEQSKVNEETLPAEEKLKMYHSLAGSLQDSGIVLKRVTIHLEDLAPHLDPLAYEKARHQIQSWQGELKLLTSAIGETVTECESRMVQSIDFQTEMSRSLDWLRRVKAELSGPVYLDLNLQDIQEEIRKIQIHQEEVQSSLRIMNALSHKEKEKFTKAKELISADLEHSLAELSELDGDIQEALRTRQATLTEIYSQCQRYYQVFQAANDWLEDAQELLQLAGNGLDVESAEENLKSHMEFFSTEDQFHSNLEELHSLVATLDPLIKPTGKEDLEQKVASLELRSQRMSRDSGAQVDLLQRCTAQWHDYQKAREEVIELMNDTEKKLSEFSLLKTSSSHEAEEKLSEHKALVSVVNSFHEKIVALEEKASQLEKTGNDASKATLSRSMTTVWQRWTRLRAVAQDQEKILEDAVDEWTGFNNKVKKATEMIDQLQDKLPGSSAEKASKAELLTLLEYHDTFVLELEQQQSALGMLRQQTLSMLQDGAAPTPGEEPPLMQEITAMQDRCLNMQEKVKTNGKLVKQELKDREMVETQINSVKCWVQETKEYLGNPTIEIDAQLEELQILLTEATNHRQNIEKMAEEQKEKYLGLYTILPSELSLQLAEVALDLKIRDQIQDKIKEVEQSKATSQELSRQIQKLAKDLTTILTKLKAKTDNVVQAKTDQKVLGEELDGCNSKLMELDAAVQKFLEQNGQLGKPLAKKIGKLTELHQQTIRQAENRLSKLNQAASHLEEYNEMLELILKWIEKAKVLAHGTIAWNSASQLREQYILHQTLLEESKEIDSELEAMTEKLQYLTSVYCTEKMSQQVAELGRETEELRQMIKIRLQNLQDAAKDMKKFEAELKKLQAALEQAQATLTSPEVGRLSLKEQLSHRQHLLSEMESLKPKVQAVQLCQSALRIPEDVVASLPLCHAALRLQEEASRLQHTAIQQCNIMQAAVVQYEQYEQEMKHLQQLIEGAHREIEDKPVATSNIQELQAQISRHEELAQKIKGYQEQIASLNSKCKMLTMKAKHATMLLTVTEVEGLAEGTEDLDGELLPTPSAHPSVVMMTAGRCHTLLSPVTEESGEEGTNSEISSPPACRSPSPVANTDASVNQDIAYYQALSAERLQTDAAKIHPSTSASQEFYEPGLEPSATAKLGDLQRSWETLKNVISEKQRTLYEALERQQKYQDSLQSISTKMEAIELKLSESPEPGRSPESQMAEHQALMDEILMLQDEINELQSSLAEELVSESCEADPAEQLALQSTLTVLAERMSTIRMKASGKRQLLEEKLNDQLEEQRQEQALQRYRCEADELDSWLLSTKATLDTALSPPKEPMDMEAQLMDCQNMLVEIEQKVVALSELSVHNENLLLEGKAHTKDEAEQLAGKLRRLKGSLLELQRALHDKQLNMQGTAQEKEESDVDLTATQSPGVQEWLAQARTTWTQQRQSSLQQQKELEQELAEQKSLLRSVASRGEEILIQHSAAETSGDAGEKPDVLSQELGMEGEKSSAEDQMRMKWESLHQEFSTKQKLLQNVLEQEQEQVLYSRPNRLLSGVPLYKGDVPTQDKSAVTSLLDGLNQAFEEVSSQSGGAKRQSIHLEQKLYDGVSATSTWLDDVEERLFVATALLPEETETCLFNQEILAKDIKEMSEEMDKNKNLFSQAFPENGDNRDVIEDTLGCLLGRLSLLDSVVNQRCHQMKERLQQILNFQNDLKVLFTSLADNKYIILQKLANVFEQPVAEQIEAIQQAEDGLKEFDAGIIELKRRGDKLQVEQPSMQELSKLQDMYDELMMIIGSRRSGLNQNLTLKSQYERALQDLADLLETGQEKMAGDQKIIVSSKEEIQQLLDKHKEYFQGLESHMILTETLFRKIISFAVQKETQFHTELMAQASAVLKRAHKRGVELEYILETWSHLDEDQQELSRQLEVVESSIPSVGLVEENEDRLIDRITLYQHLKSSLNEYQPKLYQVLDDGKRLLISISCSDLESQLNQLGECWLSNTNKMSKELHRLETILKHWTRYQSESADLIHWLQSAKDRLEFWTQQSVTVPQELEMVRDHLNAFLEFSKEVDAQSSLKSSVLSTGNQLLRLKKVDTATLRSELSRIDSQWTDLLTNIPAVQEKLHQLQMDKLPSRHAISEVMSWISLMENVIQKDEDNIKNSIGYKAIHEYLQKYKGFKIDINCKQLTVDFVNQSVLQISSQDVESKRSDKTDFAEQLGAMNKSWQILQGLVTEKIQLLEGLLESWSEYENNVQCLKTWFETQEKRLKQQHRIGDQASVQNALKDCQDLEDLIKAKEKEVEKIEQNGLALIQNKKEDVSSIVMSTLRELGQTWANLDHMVGQLKILLKSVLDQWSSHKVAFDKINSYLMEARYSLSRFRLLTGSLEAVQVQVDNLQNLQDDLEKQERSLQKFGSITNQLLKECHPPVTETLTNTLKEVNMRWNNLLEEIAEQLQSSKALLQLWQRYKDYSKQCASTVQQQEDRTNELLKAATNKDIADDEVATWIQDCNDLLKGLGTVKDSLFFLHELGEQLKQQVDASAASAIQSDQLSLSQHLCALEQALCKQQTSLQAGVLDYETFAKSLEALEAWIVEAEEILQGQDPSHSSDLSTIQERMEELKGQMLKFSSMAPDLDRLNELGYRLPLNDKEIKRMQNLNRHWSLISSQTTERFSKLQSFLLQHQTFLEKCETWMEFLVQTEQKLAVEISGNYQHLLEQQRAHELFQAEMFSRQQILHSIIIDGQRLLEQGQVDDRDEFNLKLTLLSNQWQGVIRRAQQRRGIIDSQIRQWQRYREMAEKLRKWLVEVSYLPMSGLGSVPIPLQQARTLFDEVQFKEKVFLRQQGSYILTVEAGKQLLLSADSGAEAALQAELAEIQEKWKSASMRLEEQKKKLAFLLKDWEKCEKGIADSLEKLRTFKKKLSQSLPDHHEELHAEQMRCKELENAVGSWTDDLTQLSLLKDTLSAYISADDISILNERVELLQRQWEELCHQLSLRRQQIGERLNEWAVFSEKNKELCEWLTQMESKVSQNGDILIEEMIEKLKKDYQEEIAIAQENKIQLQQMGERLAKASHESKASEIEYKLGKVNDRWQHLLDLIAARVKKLKETLVAVQQLDKNMSSLRTWLAHIESELAKPIVYDSCNSEEIQRKLNEQQELQRDIEKHSTGVASVLNLCEVLLHDCDACATDAECDSIQQATRNLDRRWRNICAMSMERRLKIEETWRLWQKFLDDYSRFEDWLKSSERTAAFPSSSGVIYTVAKEELKKFEAFQRQVHECLTQLELINKQYRRLARENRTDSACSLKQMVHEGNQRWDNLQKRVTSILRRLKHFIGQREEFETARDSILVWLTEMDLQLTNIEHFSECDVQAKIKQLKAFQQEISLNHNKIEQIIAQGEQLIEKSEPLDAAIIEEELDELRRYCQEVFGRVERYHKKLIRLPLPDDEHDLSDRELELEDSAALSDLHWHDRSADSLLSPQPSSNLSLSLAQPLRSERSGRDTPASVDSIPLEWDHDYDLSRDLESAMSRALPSEDEEGQDDKDFYLRGAVGLSGDHSALESQIRQLGKALDDSRFQIQQTENIIRSKTPTGPELDTSYKGYMKLLGECSSSIDSVKRLEHKLKEEEESLPGFVNLHSTETQTAGVIDRWELLQAQALSKELRMKQNLQKWQQFNSDLNSIWAWLGDTEEELEQLQRLELSTDIQTIELQIKKLKELQKAVDHRKAIILSINLCSPEFTQADSKESRDLQDRLSQMNGRWDRVCSLLEEWRGLLQDALMQCQGFHEMSHGLLLMLENIDRRKNEIVPIDSNLDAEILQDHHKQLMQIKHELLESQLRVASLQDMSCQLLVNAEGTDCLEAKEKVHVIGNRLKLLLKEVSRHIKELEKLLDVSSSQQDLSSWSSADELDTSGSVSPTSGRSTPNRQKTPRGKCSLSQPGPSVSSPHSRSTKGGSDSSLSEPGPGRSGRGFLFRVLRAALPLQLLLLLLIGLACLVPMSEEDYSCALSNNFARSFHPMLRYTNGPPPL

SEQ ID NO: 167 - protein, 552 aa, Homo sapiens
MGCSAKARWAAGALGVAGLLCAVLGAVMIVMVPSLIKQQVLKNVRIDPSSLSFNMWKEIPIPFYLSVYFFDVMNPSEILKGEKPQVRERGPYVYREFRHKSNITFNNNDTVSFLEYRTFQFQPSKSHGSESDYIVMPNILVLGAAVMMENKPMTLKLIMTLAFTTLGERAFMNRTVGEIMWGYKDPLVNLINKYFPGMFPFKDKFGLFAELNNSDSGLFTVFTGVQNISRIHLVDKWNGLSKVDFWHSDQCNMINGTSGQMWPPFMTPESSLEFYSPEACRSMKLMYKESGVFEGIPTYRFVAPKTLFANGSIYPPNEGFCPCLESGIQNVSTCRFSAPLFLSHPHFLNADPVLAEAVTGLHPNQEAHSLFLDIHPVTGIPMNCSVKLQLSLYMKSVAGIGQTGKIEPVVLPLLWFAESGAMEGETLHTFYTQLVLMPKVMHYAQYVLLALGCVLLLVPVICQIRSQVGAGQRAARADSHSLACWGKGASDRTLWPTAAWSPPPAAVLRLCRSGSGHCWGLRSTLASFACRVATTLPVLEGLGPSLGGGTGS

SEQ ID NO: 168 - protein, 775 aa, Homo sapiens
MASRAVVRARRCPQCPQVRAAAAAPAWAALPLSRSLPPCSNSSSFSMPLFLLLLLVLLLLLEDAGAQQGDGCGHTVLGPESGTLTSINYPQTYPNSTVCEWEIRVKMGERVRIKFGDFDIEDSDSCHFNYLRIYNGIGVSRTEIGKYCGLGLQMNHSIESKGNEITLLFMSGIHVSGRGFLASYSVIDKQDLITCLDTASNFLEPEFSKYCPAGCLLPFAEISGTIPHGYRDSSPLCMAGVHAGVVSNTLGGQISVVISKGIPYYESSLANNVTSVVGHLSTSLFTFKTSGCYGTLGMESGVIADPQITASSVLEWTDHTGQENSWKPKKARLKKPGPPWAAFATDEYQWLQIDLNKEKKITGIITTGSTMVEHNYYVSAYRILYSDDGQKWTVYREPGVEQDKIFQGNKDYHQDVRNNFLPPIIARFIRVNPTQWQQKIAMKMELLGCQFIPKGRPPKLTQPPPPRNSNDLKNTTAPPKIAKGRAPKFTQPLQPRSSNEFPAQTEQTTASPDIRNTTVTPNVTKDVALAAVLVPVLVMVLTTLILILVCAWHWRNRKKKTEGTYDLPYWDRAGWWKGMKQFLPAKAVDHEETPVRYSSSEVNHLSPREVTTVLQADSAEYAQPLVGGIVGTLHQRSTFKPEEGKEAGYADLDPYNSPGQEVYHAYAEPLPITGPEYATPIIMDMSGHPTTSVGQPSTSTFKATGNQPPPLVGTYNTLLSRTDSCSSAQAQYDTPKAGKPGLPAPDELVYQVPQSTQEVSGAGRDGECDVFKEIL

SEQ ID NO: 169 - protein, 1445 aa, Homo sapiens
MRRLLEPCWWILFLKITSSVLHYVVCFPALTEGYVGALHENRHGSAVQIRRRKASGDPYWAYSGAYGPEHWVTSSVSCGGRHQSPIDILDQYARVGEEYQELQLDGFDNESSNKTWMKNTGKTVAILLKDDYFVSGAGLPGRFKAEKVEFHWGHSNGSAGSEHSINGRRFPVEMQIFFYNPDDFDSFQTAISENRIIGAMAIFFQVSPRDNSALDPIIHGLKGVVHHEKETFLDPFVLRDLLPASLGSYYRYTGSLTTPPCSEIVEWIVFRRPVPISYHQLEAFYSIFTTEQQDHVKSVEYLRNNFRPQQRLHDRVVSKSAVRDSWNHDMTDFLENPLGTEASKVCSSPPIHMKVQPLNQTALQVSWSQPETIYHPPIMNYMISYSWTKNEDEKEKTFTKDSDKDLKATISHVSPDSLYLFRVQAVCRNDMRSDFSQTMLFQANTTRIFQGTRIVKTGVPTASPASSADMAPISSGSSTWTSSGIPFSFVSMATGMGPSSSGSQATVASVVTSTLLAGLGFGGGGISSFPSTVWPTRLPTAASASKQAARPVLATTEALASPGPDGDSSPTKDGEGTEEGEKDEKSESEDGEREHEEDGEKDSEKKEKSGVTHAAEERNQTEPSPTPSSPNRTAEGGHQTIPGHEQDHTAVPTDQTGGRRDAGPGLDPDMVTSTQVPPTATEEQYAGSDPKRPEMPSKKPMSRGDRFSEDSRFITVNPAEKNTSGMISRPAPGRMEWIIPLIVVSALTFVCLILLIAVLVYWRGCNKIKSKGFPRRFREVPSSGERGEKGSRKCFQTAHFYVEDSSSPRVVPNESIPIIPIPDDMEAIPVKQFVKHIGELYSNNQHGFSEDFEEVQRCTADMNITAEHSNHPENKHKNRYINILAYDHSRVKLRPLPGKDSKHSDYINANYVDGYNKAKAYIATQGPLKSTFEDFWRMIWEQNTGIIVMITNLVEKGRRKCDQYWPTENSEEYGNIIVTLKSTKIHACYTVRRFSIRNTKVKKGQKGNPKGRQNERVVIQYHYTQWPDMGVPEYALPVLTFVRRSSAARMPETGPVLVHCSAGVGRTGTYIVIDSMLQQIKDKSTVNVLGFLKHIRTQRNYLVQTEEQYIFIHDALLEAILGKETEVSSNQLHSYVNSILIPGVGGKTRLEKQFKLVTQCNAKYVECFSAQKECNKEKNRNSSVVPSERARVGLAPLPGMKGTDYINASYIMGYYRSNEFIITQHPLPHTTKDFWRMIWDHNAQIIVMLPDNQSLAEDEFVYWPSREESMNCEAFTVTLISKDRLCLSNEEQIIIHDFILEATQDDYVLEVRHFQCPKWPNPDAPISSTFELINVIKEEALTRDGPTIVHDEYGAVSAGMLCALTTLSQQLENENAVDVFQVAKMINLMRPGVFTDIEQYQFIYKAMLSLVSTKENGNGPMTVDKNGAVLIADESDPAESMESLV

SEQ ID NO: 170 - protein, 1310 aa, Homo sapiens
MAQLWLSCFLLPALVVSVAANVAPKFLANMTSVILPEDLPVGAQAFWLVAEDQDNDPLTYGMSGPNAYFFAVTPKTGEVKLASALDYETLYTFKVTISVSDPYIQVQREMLVIVEDRNDNAPVFQNTAFSTSINETLPVGSVVFSVLAVDKDMGSAGMVVYSIEKVIPSTGDSEHLFRILANGSIVLNGSLSYNNKSAFYQLELKACDLGGMYHNTFTIQCSLPVFLSISVVDQPDLDPQFVREFYSASVAEDAAKGTSVLTVEAVDGDKGINDPVIYSISYSTRPGWFDIGADGVIRVNGSLDREQLLEADEEVQLQVTATETHLNIYGQEAKVSIWVTVRVMDVNDHKPEFYNCSLPACTFTPEEAQVNFTGYVDEHASPRIPIDDLTMVVYDPDKGSNGTFLLSLGGPDAEAFSVSPERAVGSASVQVLVRVSALVDYERQTAMAVQVVATDSVSQNFSVAMVTIHLRDINDHRPTFPQSLYVLTVPEHSATGSVVTDSIHATDPDTGAWGQITYSLLPGNGADLFQVDPVSGTVTVRNGELLDRESQAVYYLTLQATDGGNLSSSTTLQIHLLDINDNAPVVSGSYNIFVQEEEGNVSVTIQAHDNDEPGTNNSRLLFNLLPGPYSHNFSLDPDTGLLRNLGPLDREAIDPALEGRIVLTVLVSDCGEPVLGTKVNVTITVEDINDNLPIFNQSSYNFTVKEEDPGVLVGVVKAWDADQTEANNRISFSLSGSGANYFMIRGLVLGAGWAEGYLRLPPDVSLDYETQPVFNLTVSAENPDPQGGETIVDVCVNVKDVNDNPPTLDVASLRGIRVAENGSQHGQVAVVVASDVDTSAQLEIQLVNILCTKAGVDVGSLCWGWFSVAANGSVYINQSKAIDYEACDLVTLVVRACDLATDPGFQAYSNNGSLLITIEDVNDNAPYFLPENKTFVIIPELVLPNREVASVRARDDDSGNNGVILFSILRVDFISKDGATIPFQGVFSIFTSSEADVFAGSIQPVTSLDSTLQGTYQVTVQARDRPSLGPFLEATTTLNLFTVDQSYRSRLQFSTPKEEVGANRQAINAALTQATRTTVYIVDIQDIDSAARARPHSYLDAYFVFPNGSALTLDELSVMIRNDQDSLTQLLQLGLVVLGSQESQESDLSKQLISVIIGLGVALLLVLVIMTMAFVCVRKSYNRKLQAMKAAKEARKTAAGVMPSAPAIPGTNMYNTERANPMLNLPNKDLGLEYLSPSNDLDSVSVNSLDDNSVDVDKNSQEIKEHRPPHTPPEPDPEPLSVVLLGRQAGASGQLEGPSYTNAGLDTTDL

SEQ ID NO: 171 - protein, 146 aa, Homo sapiens
MSAESGPGTRLRNLPVMGDGLETSQMSTTQAQAQPQPANAASTNPPPPETSNPNKPKRQTNQLQYLLRVVLKTLWKHQFAWPFQQPVDAVKLNLPDYYKIIKTPMDMGTIKKRLENNYYWNAQECIQDFNTMFTNCYIYNKFRPQM

SEQ ID NO: 172 - protein, 2472 aa, Homo sapiens
MDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

I claim:

1. A method for eliciting a CTL response against tumor cells presenting at least one of the following epitopic peptides: SEQ ID NO: 82, 8, 36, or 3 in a subject, comprising administering to said subject a composition comprising at least one polypeptide consisting of an amino acid sequence selected from the group consisting of SEQ ID NO: 82, 8, 36, and 3 in an amount sufficient to induce a CTL response to said tumor cells.

2. The method of claim 1 wherein said polypeptide comprises at least two epitopic peptides.

3. The method of claim 1 wherein said polypeptide comprises at least three epitopic peptides.

4. The method of claim 1, wherein said composition further comprises an adjuvant.

5. The method of claim 4, wherein said adjuvant is selected from the group consisting of complete Freund's adjuvant, incomplete Freund's adjuvant, Montanide ISA-51, LAG-3, aluminum phosphate, aluminum hydroxide, alum, and saponin.

6. The method of claim 1, wherein said composition further comprises a cytokine.

7. The method of claim 6, wherein said cytokine is selected from the group consisting of IL-1, IL-2, IL-7, IL-12, IL-15, TNF, SCF and GM-CSF.

8. The method of claim 1, wherein said composition further comprises a vehicle.

9. The method of claim 8, where said vehicle is selected from the group consisting of a liposome, metal nanoparticles and polymers.

10. The method of claim 9, wherein said liposome comprises an emulsion, a foam, a micelle, an insoluble monolayer, a liquid crystal, a phospholipid dispersion, or a lamellar layer.

11. The method of claim 2, said polypeptide comprising a first epitopic peptide and a second epitopic peptide, wherein said first epitopic peptide comprises the amino acid sequence selected from the group consisting of SEQ ID NO: 82, 29, 8, 33, 19, 34, 36, and 67 and said second epitopic peptide comprises an amino acid sequence selected from the group consisting of SEQ ID NO: 82, 29, 8, 33, 19, 34, 36, and 67.

12. A method of stimulating an immune response in an immunologically competent animal comprising administering a composition comprising at least one epitopic peptide comprising an amino acid sequence selected from the group consisting of SEQ ID NO: 82, 29, 8, 33, 19, 34, 36, and 67 where said composition is present in a pharmaceutically acceptable carrier and in an amount sufficient to elicit production of antibodies or cells that react with said peptide.

* * * * *